(12) United States Patent
Maeder et al.

(10) Patent No.: US 9,938,521 B2
(45) Date of Patent: Apr. 10, 2018

(54) CRISPR/CAS-RELATED METHODS AND COMPOSITIONS FOR TREATING LEBER'S CONGENITAL AMAUROSIS 10 (LCA10)

(71) Applicant: EDITAS MEDICINE, INC.

(72) Inventors: Morgan L. Maeder, Jamaica Plain, MA (US); David A. Bumcrot, Belmont, MA (US); Shen Shen, Watertown, MA (US)

(73) Assignee: EDITAS MEDICINE, INC., Cambridge, MA (US)

( * ) Notice: Subject to any disclaimer, the term of this patent is extended or adjusted under 35 U.S.C. 154(b) by 0 days.

(21) Appl. No.: 14/644,181

(22) Filed: Mar. 10, 2015

(65) Prior Publication Data

US 2015/0252358 A1 Sep. 10, 2015

Related U.S. Application Data

(60) Provisional application No. 61/950,733, filed on Mar. 10, 2014, provisional application No. 62/036,576, filed on Aug. 12, 2014.

(51) Int. Cl.
| | | |
|---|---|---|
| *C12N 15/10* | (2006.01) |
| *A61K 48/00* | (2006.01) |
| *C12N 15/11* | (2006.01) |
| *C12N 7/00* | (2006.01) |
| *C12N 9/22* | (2006.01) |
| *C12N 15/113* | (2010.01) |
| *C12N 15/86* | (2006.01) |

(52) U.S. Cl.
CPC ........... *C12N 15/1024* (2013.01); *C12N 9/22* (2013.01); *C12N 15/11* (2013.01); *C12N 15/113* (2013.01); *C12N 15/86* (2013.01); *C12N 2310/10* (2013.01); *C12N 2310/20* (2017.05); *C12N 2750/14132* (2013.01); *C12N 2750/14142* (2013.01); *C12N 2750/14143* (2013.01); *C12N 2750/14145* (2013.01); *C12N 2750/14151* (2013.01)

(58) Field of Classification Search
None
See application file for complete search history.

(56) References Cited

U.S. PATENT DOCUMENTS

| | | | |
|---|---|---|---|
| 5,443,505 A | 8/1995 | Wong et al. |
| 5,766,242 A | 6/1998 | Wong et al. |
| 6,251,090 B1 | 6/2001 | Avery et al. |
| 6,299,895 B1 | 10/2001 | Hammang et al. |
| 6,413,540 B1 | 7/2002 | Yaacobi et al. |
| 6,416,777 B1 | 7/2002 | Yaacobi et al. |
| 6,586,240 B1 | 7/2003 | Singer et al. |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Ran et al. |
| 8,871,445 B2 | 10/2014 | Cong et al. |
| 8,889,356 B2 | 11/2014 | Zhang |
| 8,889,394 B2 | 11/2014 | Chalasani et al. |
| 8,889,418 B2 | 11/2014 | Ran et al. |
| 8,895,308 B1 | 11/2014 | Ran et al. |
| 8,906,616 B2 | 12/2014 | Hsu et al. |
| 8,932,814 B2 | 1/2015 | Cong et al. |
| 8,945,839 B2 | 2/2015 | Zhang |
| 8,993,233 B2 | 3/2015 | Sanjana et al. |
| 8,999,641 B2 | 4/2015 | Zhang et al. |
| 2003/0186238 A1 | 10/2003 | Allawi et al. |
| 2007/0020627 A1 | 1/2007 | Barbas et al. |
| 2010/0055793 A1 | 3/2010 | Chandrasegaran et al. |
| 2010/0055798 A1 | 3/2010 | Battersby et al. |
| 2010/0076057 A1 | 3/2010 | Sontheimer et al. |
| 2011/0059502 A1 | 3/2011 | Chalasani et al. |
| 2011/0189776 A1 | 8/2011 | Terns et al. |
| 2011/0223638 A1 | 9/2011 | Wiedenheft et al. |
| 2011/0236894 A1 | 9/2011 | Rao et al. |
| 2011/0301073 A1 | 12/2011 | Gregory et al. |
| 2012/0270273 A1 | 10/2012 | Zhang et al. |
| 2013/0130248 A1 | 5/2013 | Haurwitz et al. |
| 2013/0253040 A1 | 9/2013 | Miller et al. |
| 2014/0068797 A1 | 3/2014 | Doudna et al. |
| 2014/0179770 A1 | 6/2014 | Zhang et al. |
| 2014/0242699 A1 | 8/2014 | Zhang et al. |
| 2014/0309177 A1 | 10/2014 | Perez-Pinera et al. |
| 2014/0315985 A1 | 10/2014 | May et al. |
| 2014/0335620 A1 | 11/2014 | Ran et al. |
| 2014/0342456 A1 | 11/2014 | Mali et al. |
| 2014/0342457 A1 | 11/2014 | Mali et al. |

(Continued)

FOREIGN PATENT DOCUMENTS

| | | |
|---|---|---|
| WO | 2000040089 A1 | 7/2000 |
| WO | 2001028474 A1 | 4/2001 |

(Continued)

OTHER PUBLICATIONS

Maeder, et al. (2016) "Therapeutic Correction of an LCA-Causing Splice Defect in the CEP290 Gene by CRISPR/Cas-Mediated Gene Editing", Molecular Therapy, 24(Suppl. 1): p. S51-S52 (Abstract 124).*
Burnight, et al. (May 8, 2014 online) "CEP290 gene transfer resuces Leber congenital amaurosis cellular phenotype", Gene Therapy, 21: 662-72.*
Jocelyn Kaiser (May 3, 2016) "The gene editor CRISPR won't fully fix sick people any time soon. Here's why", Biology, Technology, CRISPR, DOI: 10.1126/science.aaf5689, 5 pages long. Found at http://www.sciencemag.org/news/2016/05/gene-editor-crispr-won-t-fully-fix-sick-people-anytime-soon-here-s-why.*
Canver (2009) "Evaluation of the Clinical Success of Ex Vivo and In Vivo Gene Therapy" Journal of Young Investigators, http://www.jyi.org/issue/evaluation-of-the-clinical-success-of-ex-vivo-and-in-vivo-gene-therapy/, 9 pages.*
Rao, et al. (2014) "Cell and Gene Therapy", Developmental Opthalmology, 53: 167-77, Provided by way of the HHS manuscript, 13 pages long, e.g., p. 2.*

(Continued)

*Primary Examiner* — Robert M Kelly
(74) *Attorney, Agent, or Firm* — Perkins Coie LLP; Patrick D. Morris

(57) ABSTRACT

CRISPR/CAS-related compositions and methods for treatment of Leber's Congenital Amaurosis 10 (LCA10) are disclosed.

39 Claims, 74 Drawing Sheets

(56) References Cited

U.S. PATENT DOCUMENTS

| | | |
|---|---|---|
| 2014/0342458 A1 | 11/2014 | Mali et al. |
| 2014/0356958 A1 | 12/2014 | Mali et al. |
| 2015/0232833 A1 | 8/2015 | Mali et al. |
| 2015/0259704 A1 | 9/2015 | Church et al. |

FOREIGN PATENT DOCUMENTS

| | | |
|---|---|---|
| WO | 2002089767 A1 | 11/2002 |
| WO | 2003072788 A1 | 9/2003 |
| WO | 2008108989 A2 | 9/2008 |
| WO | 2009/121536 A1 | 10/2009 |
| WO | 2010054108 A2 | 5/2010 |
| WO | 2011012724 A1 | 2/2011 |
| WO | 2011143124 A2 | 11/2011 |
| WO | 2011146121 A1 | 11/2011 |
| WO | 2012145601 A2 | 10/2012 |
| WO | 2012164565 A1 | 12/2012 |
| WO | 2012164656 A1 | 12/2012 |
| WO | 2012168435 A1 | 12/2012 |
| WO | 2013012674 A1 | 1/2013 |
| WO | 2013066438 A2 | 5/2013 |
| WO | 2013082519 A2 | 6/2013 |
| WO | 2013098244 A1 | 7/2013 |
| WO | 2013126794 A1 | 8/2013 |
| WO | 2013141680 A1 | 9/2013 |
| WO | 2013142578 A1 | 9/2013 |
| WO | 2013163628 A2 | 10/2013 |
| WO | 2013176772 A1 | 11/2013 |
| WO | 2013181228 A1 | 12/2013 |
| WO | 2014022702 A2 | 2/2014 |
| WO | 2014/036219 A2 | 3/2014 |
| WO | 2014059255 A1 | 4/2014 |
| WO | 2014065596 A1 | 5/2014 |
| WO | 2014018423 A8 | 6/2014 |
| WO | 2014089290 A1 | 6/2014 |
| WO | 2014093479 A1 | 6/2014 |
| WO | 2014093595 A1 | 6/2014 |
| WO | 2014093622 A2 | 6/2014 |
| WO | 2014093635 A1 | 6/2014 |
| WO | 2014093655 A2 | 6/2014 |
| WO | 2014093661 A2 | 6/2014 |
| WO | 2014093694 A1 | 6/2014 |
| WO | 2014093709 A1 | 6/2014 |
| WO | 2014093712 A1 | 6/2014 |
| WO | 2014093718 A1 | 6/2014 |
| WO | 2014099744 A1 | 6/2014 |
| WO | 2014099750 A2 | 6/2014 |
| WO | 2014124284 A1 | 8/2014 |
| WO | 2014144288 A1 | 9/2014 |
| WO | 2014144592 A2 | 9/2014 |
| WO | 2014144761 A2 | 9/2014 |
| WO | 2014152432 A2 | 9/2014 |
| WO | 2014/186585 A2 | 11/2014 |
| WO | 2014197748 A2 | 12/2014 |
| WO | 2014204578 A1 | 12/2014 |
| WO | 2014204725 A1 | 12/2014 |
| WO | 2015/006498 A2 | 1/2015 |
| WO | 2015006290 A1 | 1/2015 |
| WO | 2015006294 A2 | 1/2015 |
| WO | 2015021353 A1 | 2/2015 |
| WO | 2015027134 A1 | 2/2015 |
| WO | 2014197568 A3 | 3/2015 |
| WO | 2015035136 A2 | 3/2015 |
| WO | 2015035139 A2 | 3/2015 |
| WO | 2015035162 A2 | 3/2015 |
| WO | 2015/048577 A2 | 4/2015 |
| WO | 2015/048680 A1 | 4/2015 |
| WO | 2015013583 A3 | 4/2015 |
| WO | 2015/070083 A1 | 5/2015 |
| WO | 2015/071474 A9 | 5/2015 |
| WO | 2015077318 A1 | 5/2015 |
| WO | 2015089406 A1 | 6/2015 |
| WO | 2015099850 A1 | 7/2015 |
| WO | 2015077290 A3 | 8/2015 |
| WO | 2015/138510 A8 | 9/2015 |
| WO | 2015/195621 A1 | 12/2015 |
| WO | 2016022363 A2 | 2/2016 |
| WO | 2016/073990 A2 | 5/2016 |
| WO | 2016/182959 A1 | 11/2016 |
| WO | 2016/186772 A2 | 11/2016 |

OTHER PUBLICATIONS

Shayakhmetov, et al. (2004) "Analysis of Adenovirus Sequestration in the Liver, Transduction of Hepatic Cells, and Innate Toxicity after Injection of Fiber-Modified Vectors", Journal of Virology, 78(10): 5368-81.*

Garanto, et al. (2013) "Unexpected CEP290 mRNA Splicing in a Humanized Knock-In Mouse Model for Leber Congenital Amarosis", PLOS one, 8(11) article e79369 (10 pages long).*

Al-Attar et al., Clustered Regularly Interspaced Short Palindromic Repeats (CRISPRs): The Hallmark of an Ingenious Antiviral Defense Mechanism in Prokaryotes, Biol Chem. (2011) vol. 392, Issue 4, pp. 277-289.

Altschul et al., "Basic Local Alignment Search Tool", (1990) J. Mol. Biol. 215:403-410.

Altschul et al., "Gapped BLAST and PSI-BLAST: a new generation of protein database search programs" (1997) Nuc. Acids Res. 25:3389-3402.

Ambati et al., "Diffusion of High Molecular Weight Compounds through Sclera", (2000) Invest. Ophthalmol. Vis. Sci. 41:1181-1185.

Ambati et al., "Transscleral Delivery of Bioactive Protein to the Choroid and Retina", (2000) Invest. Ophthalmol. Vis. Sci. 41:1186-1191.

Anders et al., "Structural basis of PAM-dependent target DNA recognition by the Cas9 endonuclease", Nature 513 (7519): 569-573 (Sep. 25, 2014).

Andreas, Susanne et al., Enhanced Efficiency Through Nuclear Localization Signal Fusion on Phage .phi.C31-Integrase: Activity Comparison With Cre and FLPe Recombinase in Mammalian Cells, Nucleic Acids Research (2002) vol. 30, No. 11, p. 2299-2306.

Anonymous, Third Party Observation for EP13818570.7, Oct. 1, 2014, 15 pages.

Anonymous, Third Party Observation for EP13824232.6, Sep. 8, 2014, 48 pages.

Anonymous, Third Party Observation for EP13824232.6, Sep. 22, 2014, 19 pages.

Anonymous, Third Party Observation for EP13824232.6, Oct. 22, 2014, 7 pages.

Baala et al., "Pleiotropic Effects of CEP290 (NPHP6) Mutations Extend to Meckel Syndrome", Am J Hum Genet. 81, 170-179, 2007.

Bae S. et al: "Cas-OFFinder: a fast and versatile algorithm that searches for potential off-target sites of Cas9 RNA-guided endonucleases", Bioinformatics, vol. 30, No. 10, pp. 1473-1475 (2014).

Bainbridge et al., "Effect of Gene Therapy on Visual Function in Leber's Congenital Amaurosis", N Engl J Med. 358, 2231-2239, 2008.

Baker, M., "Gene editing at CRISPR speed," Nature Biotechnology, 2014, vol. 32(4), pp. 309-312.

Barker et al., "Increased DNA microarray hybridization specificity using sscDNA targets," BMC Genomics, 2005 Apr. 22, 2005, 6:57, 8 pages.

Baron-Benhamou et al., "Using the λN Peptide to Tether Proteins to RNAs," Methods Mole Biol., Jan. 2004, 257:135-153.

Barrangou et al., CRISPR: New Horizons in Phage Resistance and Strain Identification, Annual Review of Food Science and Technology 3: 143-162 (2012).

Barrangou, RNA-Mediated Programmable DNA Cleavage, Nature Biotechnology (2012) vol. 30, No. 9, p. 836-838.

Bassett, A.R. and Liu, J.-L., "CRISPR/Cas9 and Genome Editing in Drosophila," Journal of Genetics and Genomics, 2014, vol. 41, pp. 7-19 (including supplementary materials).

Beerli et al., "Toward controlling gene expression at will: specific regulation of the erbB-2/HER-2 promoter by using polydactyl zinc finger proteins constructed from modular building blocks," PNAS USA, 1998, 95:14628-14633.

(56) References Cited

OTHER PUBLICATIONS

Bhaya et al., CRISPR-Cas Systems in Bacteria and Archaea: Versatile Small RNAs for Adaptive Defense and Regulation, Annual Review of Genetics 45: 273-297 (2011).
Bikard et al., "Programmable repression and activation of bacterial gene expression using an engineered CRISPR-Cas system," Nucleic Acid Res., Jun. 2013 41(15):7429-7437.
Bitinaite et al., "FokI dimerization is required for DNA cleavage," Proc. Natl. Acad. Sci. USA, 1998, 95:10570-10575.
Boch et al., Breaking the Code of DNA Binding Specificity of TAL-Type III Effectors, Science 326 (5959): 1509-1512 (Dec. 11, 2009).
Boch et al., Xanthomonas AvrBs3 Family-Type III Effectors: Discovery and Function, Annu. Rev. Phytopathol. (2010) vol. 48, p. 419-436.
Briner, Alexandra E. et al., Guide RNA Functional Modules Direct Cas9 Activity and Orthogonality, Molecular Cell (Oct. 23, 2014) vol. 56, p. 333-339.
Broad Institute, Communication Forwarding Declaration of Feng Zhang for U.S. Appl. No. 14/256,912, Nov. 24, 2014, 5 pages.
Broad Institute, Information Disclosure Statement submitted for U.S. Appl. No. 14/256,912, Nov. 3, 2014, 8 pages
Broad Institute, Request for Oral Examination for EP13818570.7, dated Oct. 27, 2014, 3 pages.
Broad Institute, Response to EP Examination Report for EP13824232.6, dated Dec. 31, 2014, 44 pages.
Broad Institute, Response to Third Party Observations and Request for Oral Hearing for EP13824232.6, Oct. 27, 2014, 9 pages.
Broad Institute, Response to Third Party Observations, with redlined and clean amended claims, for EP13818570.7, Oct. 16, 2014, 30 pages.
Broad Institute, Response to Third Party Observations, with redlined and clean amended claims, for EP13824232.6, Oct. 2, 2014, 16 pages.
Brummelkamp et al., A System for Stable Expression of Short Interfering RNAs in Mammalian Cells, Science 296 (5567): 550-553 (Apr. 19, 2002).
Caldecott, "Single-strand break repair and genetic disease", Nature Reviews Genetics 9, 619-631 (Aug. 2008).
Carroll, A CRISPR Approach to Gene Targeting, Molecular Therapy (2012) vol. 20, No. 9, p. 1658-1660.
Cathomen and Joung, "Zinc-finger nucleases: the next generation emerges," Mol. Ther., 2008, 16:1200-1207.
Cermak, Tomas et al., Efficient Design and Assembly of Custom TALEN and Other TAL Effector-Based Constructs for DNA Targeting, Nucleic Acids Research (2011) vol. 39, No. 12, e82, p. 1-11.
Cho, Seung Woo et al., Supplementary Information: Targeted Genome Engineering in Human Cells With the Cas9 RNA-Guided Endonuclease, Nature Biotechnology (Mar. 2013) vol. 31, No. 3, 11 pages.
Cho, Seung Woo et al., Targeted Genome Engineering in Human Cells With the Cas9 RNA-Guided Endonuclease, Nature Biotechnology (Mar. 2013) vol. 31, No. 3, p. 230-232.
Christian, Michelle et al., Targeting DNA Double-Strand Breaks With TAL Effector Nucleases; Genetics (2010) vol. 186, p. 757-761.
Christian, Michelle et al., Targeting DNA Double-Strand Breaks With TAL Effector Nucleases; Genetics (2010), Supporting Information, 1SI-8SI.
Chylinski et al., "The tracrRNA and Cas9 families of type II CRISPR-Cas immunity systems," RNA Biol., 2013, 10(5):726-737.
Cideciyan et al., "Human gene therapy for RPE65 isomerase deficiency activates the retinoid cycle of vision but with slow rod kinetics", Proc Natl Acad Sci USA. 105, 15112-15117, 2008.
Cong et al., Multiplex Genome Engineering Using CRISPR/-Cas Systems, Science (Feb. 2013) 339 (6121), p. 819-823.
Cong, Le et al., Supplementary Material: Multiplex Genome Engineering Using CRISPR-Cas Systems, Science Express (Jan. 3, 2013).
Cong, Le et al., Supplementary Material: Multiplex Genome Engineering Using CRISPR-Cas Systems, Science Express (Jul. 5, 2012).
Coppieters et al., "Genetic Screening of LCA in Belgium: Predominance of CEP290 and Identification of Potential Modifier Alleles in AHI1 of CEP290-related Phenotypes", Hum Mutat 31, E1709-E1766, 2010.
Cradick et al., "CRISPR/Cas9 systems targeting beta-globin and CCR5 genes have substantial off-target activity," Nucleic Acids Res., 2013, 41(20):9584-92.
Datsenko, Kirill A. et al., Molecular Memory of Prior Infections Activates the CRISPR/Cas Adaptive Bacterial Immunity System, Nature Communications, Jul. 10, 2012, DOI:10.1038/ncomms1937.
Deltcheva, Elitza et al., CRISPR RNA Maturation by Trans-Encoded Small RNA and Host Factor RNase III, Nature (2011) vol. 471, p. 602-607.
Deltcheva, et al., Supplementary Figures: CRISPR RNA Maturation by Trans-Encoded Small RNA and Host Factor RNase III. Downloaded from www.nature.com/nature, p. 1-35, 2011.
Den Hollander et al., "Leber congenital amaurosis: Genes, proteins and disease mechanisms", Progress in Retinal and Eye Research . 27(4): 391-419, 2008.
Den Hollander et al., "Lighting a candle in the dark: advances in genetics and gene therapy of recessive retinal dystrophies", J Clin Invest 120: 3042-3053, 2010.
Den Hollander et al., "Mutations in the CEP290 (NPHP6) Gene Are a Frequent Cause of Leber Congenital Amaurosis", Am J Hum Genet. 79(3): 556-561, 2006.
Deveau et al., "Phage Response to CRISPR-Encoded Resistance in *Streptococcus* thermophilus", J Bacteriol 2008; 190(4): 1390-1400.
Dicarlo et al., "Genome engineering in *Saccharomyces* cerevisiae using CRISPR-Cas systems," Nucleic Acids Res., 2013, 41(7):4336-43.
Dingwall, C. et al., A Polypeptide Domain That Specifies Migration of Nucleoplasmin Into the Nucleus, Cell (1982) vol. 2, p. 449-458.
Dreszer et al., The UCSC Genome Browser database: extensions and updates 2011, Nucleic Acids Research 40: D918-D923 (2012).
Estrada-Cuzcano et al., "IQCB1 Mutations in Patients with Leber Congenital Amaurosis", Invest Ophthalmol. Vis Sci. 52(2): 834-9, 2011.
Esvelt et al., "A System for the Continuous Directed Evolution of Biomolecules", Nature 2011, 472(7344): 499-503.
Esvelt et al., "Orthogonal Cas9 proteins for RNA-guided gene regulation and editing," Nat Methods, Nov. 2013, 10(11):1116-21.
European Patent Office, Examination Report for EP 13824232.6, dated Dec. 16, 2014, 4 pages.
European Patent Office, International Search Report and Written Opinion for PCT/US2015/019790, dated Jul. 1, 2015, 13 pages.
Fonfara et al., "Phylogeny of Cas9 determines functional exchangeability of dual-RNA and Cas9 among orthologous type II CRISPR-Cas systems." Nucleic Acids Res., Feb. 2014, 42(4):2577-90.
Fu et al., "High-frequency off-target mutagenesis induced by CRISPR-Cas nucleases in human cells," Nat Biotechnol., 2013, 31:822-826.
Fu Yanfang et al: "Improving CRISPR-Cas nuclease specificity using a truncated guide RNAs", Nature Biotechnology, vol. 32, No. 3, Jan. 26, 2014, pp. 279-284.
Gabriel et al., "An unbiased genome-wide analysis of zinc-finger nuclease specificity," Nat Biotechnol., 2011, 29:816-823.
Garneau, et al., The CRISPR-Cas Bacterial Immune Systems Cleaves Bacteriophage and Plasmid DNA, Nature (2010) 468:67-71.
Gasiunas, et al., Cas9-crRNA Ribonucleoprotein Complex Mediates Specific DNA cleavage for Adaptive Immunity in Bacteria, PNAS USA (2012) vol. 109, No. 39, p. E2579-E2586.
Gilbert, et al., "CRISPR-Mediated Modular RNA-Guided Regulation of Transcription in Eukaryotes," Cell, Jul. 18, 2013, vol. 154, No. 2, pp. 442-451, Elsevier, Inc.
Goldfarb, David S. et al., Synthetic Peptides as Nuclear Localization Signals, Nature (1986) vol. 322, p. 641-644.
Gratz et al., "Genome engineering of *Drosophila* with the CRISPR RNA-guided Cas9 nuclease," Genetics, 2013, 194(4):1029-35.

(56) References Cited

OTHER PUBLICATIONS

Guilinger et al., "Fusion of catalytically inactive Cas9 to FokI nuclease improves the specificity of genome modification," Nat Biotechnol., Apr. 2014, 32(6):577-583.
Gustafsson, et al., Codon Bias and Heterologous Protein Expression, TRENDS in Biotechnology (2004) vol. 22, No. 7, p. 346-353.
Haft et al., "A Guild of 45 CRISPR-Associated (Cas) Protein Families and Multiple CRISPR/Cas Subtypes Exist in Prokaryotic Genomes", PLoS Computational Biology 2005, 1(6): e60.
Hale et al., Essential Features and Rational Design of CRISPR RNAs That Function With the Cas RAMP Module Complex to Cleave RNAs, Molecular Cell, (2012) vol. 45, Issue 3, 292-302.
Hatoum-Aslan, et al. "Mature clustered regularly interspaced, short palindromic repeats RNA 5,9,14 (crRNA) length is measured by a ruler mechanism anchored at the precursor processing site." Proc. Nat'l. Acad. Sci. USA 108 (52): 21218-21222 (Dec. 2011).
Heigwer et al., E-CRISP: fast CRISPR target site identification, Nat Methods 11(2): 122-3, (Feb. 2014).
Helou et al., "Mutation analysis of NPHP6/CEP290 in patients with Joubert syndrome and Senior-Loken syndrome", J Med Genet. 44: 657-663, 2007.
Hockemeyer et al., "Genetic engineering of human pluripotent cells using TALE nucleases," Nat Biotechnol., 2011, 29:731-734.
Hockemeyer et al., Efficient targeting of expressed and silent genes in human ESCs and iPSCs using zinc-finger nucleases, Nature Biotechnology 27 (9): 851-857 (2009).
Holt et al., Human hematopoietic stem/progenitor cells modified by zinc-finger nucleases targeted to CCR5 control HIV-1 in vivo, Nature Biotechnology 28 (8): 839-847 (Aug. 28, 2010).
Horvath et al., "CRISPR/Cas, the immune system of bacteria and archaea," Science, 2010, 327(5962):167-170.
Horvath, et al., RNA-Guided Genome Editing a la carte, Cell Research, Cell Research (2013) vol. 23: 733-734.
Hou et al., "Efficient Genome Engineering in human pluripotent stem cells using Cas9 from Neisseria meningitidis", PNAS Early Edition 2013, 1-6.
Hou et al., "Efficient genome engineering in human pluripotent stem cells using Cas9 from Neisseria meningitidis," Proc Natl Acad Sci U S A, Sep. 24, 2013, 110(39):15644-9.
Hsu Patrick D. et al., "DNA targeting specifically of RNA-guided Cas9 nucleases", Nature Biotechnology, vol. 31, No. 9, Sep. 1, 2013, pp. 827-832.
Hwang et al., "Heritable and Precise Zebrafish Genome Editing Using a CRISPR-Cas System," PLoS One, 2013, 8(7):e68708, 9 pages.
Hwang, et al., Efficient Genome Editing in Zebrafish Using a CRISPR-Cas System, Nature Biotechnology (2013) vol. 31, No. 3, p. 227-229.
Iyer et al., "Prediction of novel families of enzymes involved in oxidative and other complex modifications of bases in nucleic acids," Cell Cycle, Jun. 1, 2009, 8(11):1698-710.
Jiang et al., "RNA-guided editing of bacterial genomes using CRISPR-Cas systems," Nat Biotechnol., 2013, 31:233-239.
Jinek et al., "Structures of CAS9 Endonucleases Reveal RNA-Mediated Conformational Activation", Science, 343(6176): 1247997, 2014.
Jinek, et al., RNA-programmed genome editing in human cells; eLife 2013;2:e00471. [retrieved 1-3, 6, 7, 10-12 on Jun. 3, 2014). Retrieved from the internet. <URL:http://elife.elifesciences.org/content/2/eoo471>. 9 pages.
Jinek, M. et al., "A Programmable Dual-RNA-Guided DNA Endonuclease in Adaptive Bacterial Immunity," Science, 2012, vol. 337(6096), pp. 816-821.
Karolchik et al., The UCSC Table Browser data retrieval tool, Nucleic Acids Research 32, D493-496 (2004).
Kent et al., The Human Genome Browser at UCSC, Genome Research 12: 996-1006 (2002).
Keryer-Bibens et al., "Tethering of proteins to RNAs by bacteriophage proteins," Biol Cell, 2008, 100:125-138.

Khalil et al., Synthetic biology: applications come of age, Nature Reviews Genetics 11 (5): 367-379 (May 1, 2010).
Kim et al., Hybrid restriction enzymes: Zinc finger fusions to Fok I cleavage domain, Proceedings of the National Academy of Sciences in the United States of America 93: 1156-1160 (Feb. 1996).
King et al., En Route to Ethical Recommendations for Gene Transfer Clinical Trials, Molecular Therapy: The Journal of the American Society of Gene Therapy 16 (3): 432-438 (Mar. 2008).
Koenekoop et al., "Genetic testing for retinal dystrophies and dysfunctions: benefits, dilemmas and solutions", Clin Experiment Ophthalmol. 35(5): 473-485, 2007.
Kosuri et al., Scalable gene synthesis by selective amplification of DNA pools from high-fidelity microchips, Nature Biotechnology 28 (12): 1295-1299 (2010).
Lambowitz, Adam et al.,Group II Introns: Mobile Ribozymes that Invade DNA. Downloaded from http://schperspectives.cshlp.org/ on Dec. 29, 2014.
Langmead et al., Ultrafast and memory-efficient alignment of short DNA sequences to the human genome, Genome Biology 10 (3): R25-R25.10 (2009).
Lee et al., A Robust Approach to Identifying Tissue-Specific Gene Expression Regulatory Variants Using Personalized Human Induced Pluripotent Stem Cells, PLoS Genetics 5 (11): E10000718 (2009).
Li et al., "TAL nucleases (TALNs): hybrid proteins composed of TAL effectors and FokI DNA-cleavage domain," Nucleic Acids Res., 2011, 39(1): 359-372.
Li et al., In vivo genome editing restores haemostasis in a mouse model of haemophilia, Nature 475 (7355): 217-221 (Jun. 2011).
Li, "Mechanisms and functions of DNA mismatch repair", Cell Research (2008) 18:85-98.
Li, T. et al., "Modularly Assembled Designer TAL Effector Nucleases for Targeted Gene Knockout and Gene Replacement in Eukaryotes," Nucleic Acids Research, 2011, vol. 39(14), pp. 6315-6325.
Littink et al., "A Novel Nonsense Mutation in CEP290 Induces Exon Skipping and Leads to a Relatively Mild Retinal Phenotype", Invest Ophthalmol Vis Sci 51, 3646-3652, 2010.
Lombardo et al., Gene editing in human stem cells using zinc finger nucleases and integrase-defective lentiviral vector delivery, Nature Biotechnology 25 (11): 1298-1306 (Nov. 2007).
Lorenz et al., ViennaRNA Package 2.0, Algorithms for Molecular Biology 6:26 (14 pages) (2011).
Maeder et al., "CRISPR RNA-guided activation of endogenous human genes," Nat Methods, 2013, 10:977-979.
Maeder et al., "Rapid "open-source" engineering of customized zinc-finger nucleases for highly efficient gene modification," Mol Cell, 2008, 31(2):294-301.
Maguire et al., "Age-dependent effects of RPE65 gene therapy for Leber's congenital amaurosis: a phase 1 dose-escalation trial", The Lancet, vol. 374, No. 9701, Nov. 7, 2009, pp. 1597-1605.
Maguire et al., "Safety and Efficacy of Gene Transfer for Leber's Congenital Amaurosis" N Engl J Med. 358: 2240-2248, 2008.
Makarova et al., "A putative RNA-interference-based immune system in prokaryotes: computational analysis of the predicted enzymatic machinery, functional analogies with eukaryotic RNAi, and hypothetical mechanisms of action," Biol. Direct, 2006, 1:7-32.
Makarova et al., "Unification of Cas protein families and a simple scenario for the origin and evolution of CRISPR-Cas systems," Biol. Direct, 2011, 6:38, 27 pages.
Makarova et al., Evolution and Classification of the CRISPR-CAS Systems, Nature Reviews Microbiology (2011) vol. 9, No. 6, p. 467-477.
Mali et al., "CAS9 transcriptional activators for target specificity screening and paired nickases for cooperative genome engineering," Nat Biotechnol., 2013, 31:833-838.
Mali et al., RNA-Guided Human Genome engineering via Cas9, Science, 2013, 339:823-826. Published Online Jan. 2, 2013.
Mali, P. et al., "Cas9 as a Versatile Tool for Engineering Biology," Nature Methods, 2013, vol. 10 (10), pp. 957-963.
Marteijn et al., "Understanding nucleotide excision repair and its roles in cancer and ageing", Nature Reviews Molecular Cell Biology 15, 465-481 (2014).

(56) References Cited

OTHER PUBLICATIONS

Mathews et al., Expanded Sequence Dependence of Thermodynamic Parameters Improves Prediction of RNA Secondary Structure, Journal of Molecular Biology 288: 911-940 (1999).
Miller et al., "An improved zinc-finger nuclease architecture for highly specific genome editing," Nat Biotechnol., 2007, 25:778-785.
Miller, et al., A TALE Nuclease Architecture for Efficient Genome Editing Nature Biotechnology (2011) vol. 29, No. 2, p. 143-150.
Miyagishi et al., U6 promoter-driven siRNAs with four uridine 3' overhangs efficiently suppress targeted gene expression in mammalian cells, Nature Biotechnology 20 (5): 497-500 (May 2002).
Moscou et al., A Simple Cipher Governs DNA Recognition by TAL Effectors, Science 326 (5959): 1501 (Dec. 11, 2009).
Myers E. and W Miller, Optimal alignments in linear space, Comput. Appl. Biosci. 4(1):11-17 (1988).
Nakamura, et al., Codon Usage Tabulated From International DNA Sequence Databases: Status for the Year 2000, Nucleic Acids Research (2000) vol. 28, No. 1, p. 292.
Needleman and Wunsch "A General Method Applicable to the Search for Similarities in the Amino Acid Sequence or Two Proteins", (1970) J. Mol. Biol. 48:444-453.
Nishimasu et al., "Crystal structure of Cas9 in complex with guide RNA and target DNA," Cell, 2014, 156:935-949.
Pattanayak et al., "High-throughput profiling of off-target DNA cleavage reveals RNA-programmed Cas9 nuclease specificity," Nat Biotechnol., 2013, 31:839-843.
Pattanayak et al., "Revealing off-target cleavage specificities of zinc-finger nucleases by in vitro selection," Nat Methods, 2011, 8:765-770.
Patterson, Stacey S. et al., Codon Optimization of Bacterial Luciferase (lux) for Expression in Mammalian Cells, J. Ind. Microbio. Biotechnology (2005) vol. 32, p. 115-123.
Pearson and Lipman, Improved tools for biological sequence comparison, Proc. Nat'l. Acad. Sci. USA 85:2444-2448 (Apr. 1988).
Perez et al., "Establishment of HIV-1 resistance in CD4+ T cells by genome editing using zinc-finger nucleases," Nat Biotechnol., 2008, 26:808-816.
Perrault et al., Spectrum of NPHP6/CEP290 Mutations in Leber Congenital Amaurosis and Delineation of the Associated Phenotype, Hum Mutat. 28(4):4 16, 2007.
Porteus, Matthew H. et al., Gene Targeting Using Zinc Finger Nucleases, Nature Biotechnology (2005) vol. 23, No. 8, p. 967-973.
Pougach, Ksenia et al., Transcription, Processing and Function of CRISPR Cassettes in *Escherichia coli*, Mol. Microbiol, Sep. 2010, 77(6), p. 1367-1379.
Pride et al., Analysis of streptococcal CRISPRs from human saliva reveals substantial sequence diversity within and between subjects over time, Genome Research 21: 126-136 (2011).
Purnick et al., The second wave of synthetic biology: from modules to systems, Nature Reviews Molecular Cell Biology 10 (6): 410-422 (Jun. 2009).
Qi et al., "Repurposing CRISPR as an RNA-Guided Platform for Sequence-Specific Control of Gene Expression," Cell, Feb. 2013, 152:1173-1183.
Qi, L. et al., "RNA Processing Enables Predictable Programming of Gene Expression," Nature Biotechnology, 2012, vol. 30(10), pp. 1002-1007 (including Supplementary Information).
Quinlan et al., BEDTools: a flexible suite of utilities for comparing genomic features, Bioinformatics 26 (6): 841-842 (Mar. 15, 2010).
Ran F Ann et al: "Double Nicking by RNA-Guided CRISPR Cas9 for Enhanced Genome Editing Specificity", CELL, vol. 154, No. 6, Sep. 2013, pp. 1380-1389.
Rand, Tim A. et al., Argonaute2 Cleaves the Anti-Guide Strand of siRNA During RISC Activation, Cell (2005) vol. 123, p. 621-629.
Raymond, et al., High-Efficiency FLP and PhiC31 Site-Specific Recombination in Mammalian Cells, PLoS One, 2007, vol. 2(1), p. e162.
Rebar et al., Zinc finger phage: affinity selection of fingers with new DNA-binding specificities, Science 263 (5147): 671-673 (Feb. 1994).
Rebar, Edward J. et al., Induction of Angiogenesis in a Mouse Model Using Engineered Transcription Factors, Nature Medicine (Dec. 2002) vol. 8, No. 12, p. 1427-1432.
Regalado, A., "Who Owns the Biggest Biotech Discovery of the Century?," MIT Technology Review, Dec. 4, 2014, http://www.technologyreview.com/featuredstory/532796/who-owns-the-biggest--biotech-discovery-of-the-century/.
Reyon et al., "FLASH assembly of TALENs for high-throughput genome editing," Nat Biotech, 2012, 30:460-465.
Rho et al. "Diverse CRISPRs Evolving in Human Microbiomes." PLoS Genetics. vol. 8, No. 6. 1-14 pp. 1-12. Jun. 2012. entire document.
Sander Jeffry D et al: "CRISPR-Cas systems for editing, regulating and targeting genomes", Nature Biotechnology, vol. 32, No. 4. Mar. 2, 2014, pp. 347-355.
Sanders, "Cheap and easy technique to snip DNA could revolutionize gene therapy", Berkeley News Online, pp. 1-3 (Jan. 7, 2013).
Sanjana et al., A transcription activator-like effector toolbox for genome engineering, Nature Protocols 7 (1): 171-192 (Jan. 5, 2012).
Sapranauskas, et al., The *Streptococcus thermophilus* CRISPR-Cas System Provides Immunity in *Escherichia coli*, Nucleic Acids Research 39:9275-9282. Published Online Aug. 3, 2011.
Schramm, Laura et al., Recruitment of RNA Polymerase III to Its Target Promoters, Genes & Development (2002) vol. 16, p. 2593-2620.
Shanks, P., "Crispr Opportunities . . . For What? and for Whom?," Biopolitical Times, Dec. 4, 2014, http://www.biopoliticaltimes.org/article.php?id=8235.
Shen, et al., Generation of Gene-Modified Mice via Cas9/RNA-Mediated Gene Targeting, Cell Research (2013) vol. 23, p. 720-723.
Smith and Waterman, Comparison of biosequences, Adv. Appl. Math. 2 (4):482-489.
Sontheimer, Erik Project 7: Establishing RNA-Directed DNA Targeting in Eukaryotic Cells; Project dates: Nov. 16, 2011 to Dec. 31, 2012 (Feb. 4, 2012).
Sternberg et al, DNA interrogation by the CRISPR RNA-guided endonuclease Cas9, Nature 507: 62-67 (Mar. 6, 2014).
Stone, Leber Congenital Amaurosis—A Model for Efficient Genetic Testing of Heterogeneous Disorders: LXIV Edward Jackson Memorial Lecture, Am J Opththalmol. 144(6): 791-811, 2007.
Sugimoto et al., "Thermodynamic parameters to predict stability of RNA/DNA hybrid duplexes," Biochemistry, 1995, 34:11211-11216.
Sugimoto et al., "Thermodynamics-structure relationship of single mismatches in RNA/DNA duplexes," Biochemistry, Sep. 19, 2000, 39(37):11270-81.
Szczepek et al., "Structure-based redesign of the dimerization interface reduces the toxicity of zinc-finger nucleases," Nat Biotechnol., 2007, 25:786-793.
Terns and Terns, "CRISPR-based adaptive immune systems," Curr Opin Microbiol., 2011, 14:321-327.
Thurman et al., The accessible chromatin landscape of the human genome, Nature 489 (7414): 75-82 (Sep. 6, 2012).
Tolia, Niraj H. et al., Slicer and the Argonautes, Nature Chemical Biology (2007) vol. 3, No. 1, p. 36-43.
Tolpin, Thomas W., Third Party Observation for EP13793997.1, Jan. 6, 2015, 50 pages.
Tsai et al., "Dimeric CRISPR RNA-guided FokI nucleases for highly specific genome editing," Nat Biotechnol., Apr. 2014, 32(6):569-576.
U.S. Appl. No. 61/613,373, filed Mar. 20, 2012, Siksnys et al.
U.S. Appl. No. 61/625,420, filed Apr. 17, 2012, Siksnys et al.
U.S. Appl. No. 61/652,086, filed May 25, 2012, Jinek et al.
U.S. Appl. No. 61/716,256, filed Oct. 19, 2012, Jinek et al.
U.S. Appl. No. 61/734,256, filed Dec. 6, 2012, Chen et al.
U.S. Appl. No. 61/735,876, filed Dec. 11, 2012, Wiedenheft.
U.S. Appl. No. 61/736,527, filed Dec. 12, 2012, Zhang et al.
U.S. Appl. No. 61/738,355, filed Dec. 17, 2012, Church et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/779,169, filed Mar. 13, 2013, Mali et al.

(56) References Cited

OTHER PUBLICATIONS

U.S. Appl. No. 61/794,422, filed Mar. 15, 2013, Knight et al.
U.S. Appl. No. 61/799,531, filed Mar. 15, 2013, Wiedenheft.
U.S. Appl. No. 61/950,733, filed Mar. 10, 2014, Maeder et al.
U.S. Appl. No. 62/036,576, filed Aug. 12, 2014, Maeder et al.
United States Patent and Trademark Office, International Search Report and Written Opinion for PCT/US2013/075317, dated Apr. 15, 2014, 12 pages.
United States Patent and Trademark Office, International Search Report and Written Opinion for PCT/US2013/075326, dated Aug. 22, 2014, 13 pages.
United States Patent and Trademark Office, International Search Report and Written Opinion for PCT/US2014/027335, dated Jul. 16, 2014, 13 pages.
United States Patent and Trademark Office, International Search Report and Written Opinion for PCT/US2014/028630, dated Jul. 24, 2014, 9 pages.
United States Patent and Trademark Office, Invitation to Pay Additional Fees and, Where Applicable, Protest Fee for PCT/US2014/029068, dated Aug. 20, 2014, 3 pages.
United States Patent and Trademark Office, Office Action for U.S. Appl. No. 14/319,380, dated Jan. 28, 2015, 47 pages.
United States Patent and Trademark Office, Office Action for U.S. Appl. No. 14/319,530, dated Apr. 1, 2015, 23 pages.
Urnov, Fyodor D. et al., Highly Efficient Endogenous Human Gene Correction Using Designed Zinc-Finger Nucleases, Nature (2005) vol. 435, p. 646-651.
Valente et al., Mutations in CEP290, which encodes a centrosomal protein, cause pleiotropic forms of Joubert syndrome, Nat Genet. 38: 623-625, 2006.
Van de Oost, John, New Tool for Genome Surgery, Science (Feb. 15, 2013) vol. 336, p. 768-768.
Van der Ploeg, Analysis of CRISPR in *Streptococcus* mutans suggests frequent occurrence of acquired immunity against infection by M102-like bacteriophages, Microbiology 155: 1966-1976 (Jun. 2009).
Wang et al., "One-Step Generation of Mice Carrying Mutations in Multiple Genes by CRISPR/Cas-Mediated Genome Engineering," Cell, 2013, 153:910-918.
Wiedenheft, et al., RNA-Guided Genetic Silencing Systems in Bacteria and Archaea, Nature (2012) vol. 482, p. 331-338.
Wu, X et al., Genome-Wide Binding of the CRISPR Endonuclease Cas9 in Mammalian Cells, Nature Biotechnology p. 1-9. Published Online Apr. 20, 2014.
Wu, Yuxuan et al.: "Correction of a Genetic Disease in Mouse via Use of CRISPR-Cas9". Cell Stem Cell, vol. 13, No. 6, Dec. 5, 2013, pp. 659-662.
Xiao A et al., CasOT: a genome-wide Cas9/gRNA off-target searching tool, Bioinformatics 30 (8): 1180-1182 (Jan. 2, 2014).
Xu et al., Design of 240,000 orthogonal 25mer DNA barcode probes, Proceedings of the National Academy of Sciences in the United States of America 106 (7): 2289-2294 (Feb. 17, 2009).
Yang, Hui et al: "One Step Generation of Mice Carrying Reporter and Conditional Alleles by CRISPR/CAS-Mediated Genome Engineering", CELL, vol. 154, No. 6, Sep. 2013, pp. 1370-1379.
Zou et al., Gene Targeting of a Disease-Related Gene in Human Induced Pluripotent Stem and Embryonic Stem Cells, Cell Stem Cell 5 (1): 97-110 (Jul. 2, 2009).
Zou et al., Site-specific gene correction of a point mutation in human iPS cells derived from an adult patient with sickle cell disease, Blood 118 (17): 4599-4608 (Oct. 27, 2011).
Barretina, J., et al., "The Cancer Cell Line Encyclopedia Enables Predictive Modeling of Anticancer Drug Sensitivity," Nature 483(7391):603-607 (2012).
Chen, X., et al., "Fusion Protein Linkers: Property, Design and Functionality," Adv. Drug Deliv. Rev. 65(10):1357-1369 (2013).
Cornish-Bowden, A., "Nomenclature for Incompletely Specified Bases in Nucleic Acid Sequences: Recommendations 1984," Nucleic Acids Res. 13(9):3021-3030 (1985).

Fine, E.J., et al., "Trans-Spliced Cas9 Allows Cleavage of HBB and CCR5 Genes in Human Cells Using Compact Expression Cassettes," Sci. Rep. 5:10777 (2015).
Friedland, A.E., et al., "Characterization of *Staphylococcus aureus* Cas9: A Smaller Cas9 for All-in-One Adeno-Associated Virus Delivery and Paired Nickase Applications," Genome Biol. 16:257 (2015).
Frit, P., et al., "Alternative End-Joining Pathway(s): Bricolage at DNA Breaks," DNA Repair (Amst) 17:81-97 (2014).
Kleinstiver, B.P., et al., "Broadening the Targeting Range of *Staphylococcus aureus* CRISPR-Cas9 by Modifying PAM Recognition," Nat. Biotechnol. 33(12):1293-1298 (2015).
Kleinstiver, B.P., et al., "Engineered CRISPR-Cas9 Nucleases with Altered PAM Specificities," Nature 523(7561):481-485 (2015).
Kleinstiver, B.P., et al., "High-Fidelity CRISPR-Cas9 Nucleases with No Detectable Genome-Wide Off-Target Effects," Nature 529(7587):490-495 (2016).
Komor, A.C., et al., "Programmable Editing of a Target Base in Genomic DNA Without Double-Stranded DNA Cleavage," Nature 533(7603):420-424 (2016).
Leber, T., "On Retinitis Pigmentosa and Congenital Amaurosis," Archiv fur Ophthalmologie 15(3):1-25 (1869).
Lee, J., et al., "Non-Endocytic Delivery of Functional Engineered Nanoparticles into the Cytoplasm of Live Cells Using a Novel, High-Throughput Microfluidic Device," Nano Lett. 12(12):6322-6327 (2012).
Li, G.M., "Mechanisms and Functions of DNA Mismatch Repair," Cell Res. 18(1):85-98 (2008).
Sander, J. D., et al., "Zinc Finger Targeter (ZiFiT): An Engineered Zinc Finger/Target Site Design Tool," Nucleic Acids Res. 35:W599-W605 (2007).
Sander, J. D., et al., "ZiFiT (Zinc Finger Targeter): An Updated Zinc Finger Engineering Tool," Nucleic Acids Res. 38:W462-468 (2010).
Selleck, W., et al., "Biophysical Characterization and Direct Delivery of S. Pyogenes Cas9 Ribonucleoprotein Complexes," Editas Medicine, Apr. 27, 2015, retrieved from URL http://www.editasmedicine.com/documents/ASGCT_poster_2015_Will.pdf.
Wang, J., et al., "Homology-Driven Genome Editing in Hematopoietic Stem and Progenitor Cells Using ZFN mRNA and AAV6 Donors," Nat. Biotechnol. 33(12):1256-1263 (2015).
Wang, J., et al., "Highly Efficient Homology-Driven Genome Editing in Human T Cells by Combining Zinc-Finger Nuclease mRNA and AAV6 Donor Delivery," Nucleic Acids Res. 44(3):e30 (2016).
Wang, T., et al., "Genetic Screens in Human Cells Using the CRISPR-Cas9 System," Science 343(6166):80-84 (2013).
Yang, J., et al., Current Understanding of Usher Syndrome Type II, Front. Biosci. (Landmark Ed.) 17:1165-1183 (2012).
Zetsche, B., et al., "A Split-Cas9 Architecture for Inducible Genome Editing and Transcription Modulation," Nat. Biotechnol. 33(2):139-142 (2015).
Zheng, A., et al., "Personalized Therapeutic Strategies for Patients with Retinitis Pigmentosa," Expert Opin. Biol. Ther. 15(3):391-402 (2015).
7th Annual 2014 Midwest Eye Research Symposium Program, Aug. 8, 2014, retrieved from: http://webeye.ophth.uiowa.edu/eig/MERS_2014.html#Back.
European Patent Office, International Search Report and Written Opinion dated Jun. 24, 2015 for PCT/US2015/019064.
European Patent Office, International Search Report and Written Opinion dated Sep. 28, 2015 for PCT/US2015/022856.
European Patent Office, International Search Report and Written Opinion dated Jul. 31, 2015 for PCT/US2015/022851.
European Patent Office, International Search Report and Written Opinion dated Aug. 10, 2015 for PCT/US2015/023906.
European Patent Office, International Search Report and Written Opinion dated Jul. 28, 2016 for PCT/US2016/029252.
U.S. Appl. No. 62/443,212.
Bothmer, A., et al., "Characterization of the Interplay Between DNA Repair and CRISPR/Cas9-Induced DNA Lesions at an Endogenous Locus," Nat. Commun. 8:13905 (2017).
Chen, F., et al., "Targeted Activation of Diverse CRISPR-Cas Systems for Mammalian Genome Editing Via Proximal CRISPR Targeting," Nat. Commun. 8:14958 (2017).

(56) References Cited

OTHER PUBLICATIONS

Hinz, J. M., et al., "Nucleosomes Selectively Inhibit Cas9 Off-Target Activity at a Site Located at the Nucleosome Edge," J. Biol. Chem. 291(48):24851-24856 (2016).

Ran, F. A., et al., "In Vivo Genome Editing Using *Staphylococcus aureus* Cas9," Nature 520(7546):186-191 (2015).

Richardson, C. D., et al., "Enhancing Homology-Directed Genome Editing by Catalytically Active and Inactive CRISPR-Cas9 Using Asymmetric Donor DNA," Nat. Biotechnol. 34(3):339-344 (2016).

Sather, B. D., et al., "Efficient Modification of CCR5 in Primary Human Hematopoietic Cells Using a Mega TAL Nuclease and AAV Donor Template," Sci. Trans. Med. 7(307):307ra156 (2015).

Shmakov, S., et al., "Discovery and Functional Characterization of Diverse Class 2 CRISPR-Cas Systems," Mol. Cell 60(3):385-397 (2015).

Smith, C., et al., "Efficient and Allele-Specific Genome Editing of Disease Loci in Human iPSCs," Mol. Ther. 23(3):570-577 (2015).

Yamano, T., et al., "Crystal Structure of Cpf1 in Complex with Guide RNA and Target DNA," Cell 165(4):949-962 (2016).

Zetsche, B., et al., "Cpf1 is a Single RNA-Guided Endonuclease of a Class 2 CRISPR-Cas System," Cell 163(3):759-771 (2015).

European Patent Office, International Search Report and Written Opinion dated Jun. 12, 2017 for PCT/US2017/024163.

European Patent Office, International Search Report and Written Opinion dated May 29, 2017 for PCT/US2017/022377.

Boye, S. E., et al., "The Human Rhodopsin Kinase Promoter in an AAV5 Vector Confers Rod- and Cone-Specific Expression in the Primate Retina," Human Gene Therapy 23(10):1101-1115 (2012).

Maeder, M. L., et al., "Therapeutic Correction of an LCA-Causing Splice Defect in the CEP290 Gene by CRISPR/Cas-Mediated Gene Editing," Presented at the American Society of Gene and cell Therapy Annual Meeting, May 4-7, 2016 in Washington, DC, XP055418197, retrieved from: http://www.editasmedicine.com/data/documents/ASGCT.

Maeder, M. L., et al., "Therapeutic Correction of an LCA-Causing Splice Defect in the CEP290 Gene by CRISPR/Cas-Mediated Genome Editing," Mol. Ther. 23(Suppl. 1):S273-S274 (2015).

European Patent Office, International Search Report and Written Opinion dated Oct. 26, 2017 for PCT/US2017/045191.

\* cited by examiner

*Streptococcus thermophilus* a) Structure (See, e.g., Karvelis et al. RNA Biology. 2013; 10(5): 841-851)

```
                                  Targeting        First Complementarity
                                   Domain                 Domain
                                ⌒⌒⌒⌒⌒⌒⌒⌒⌒⌒⌒       ⌒⌒⌒⌒⌒⌒⌒⌒⌒⌒⌒⌒⌒⌒⌒⌒⌒⌒⌒⌒
                          5'-NNNNNNNNNNNNNNNNNNNNGUUUUAGAGCUGUGUUGUUUCG-3'      (SEQ ID NO:48)
                                                 :|||||  |||||||||||||||
                     AGCCACGGUGAAAAGUUCAACUCAUGCCUGAUUCGGAAUAAAAAUU CGACACAACAAAGCGGG-5' (SEQ ID NO:49)
                     |||||||                      ⌣⌣⌣⌣⌣⌣⌣  GAG  ⌣⌣⌣⌣⌣⌣⌣⌣⌣⌣⌣⌣⌣⌣⌣⌣    5' Extension
                  U  UCGGUGUUUU-3'                Proximal          Second              Domain
                                                   Domain       Complementarity
                      Tail                                          Domain
                     Domain
```

Fig.1F

Alignment

```
S. pyogenes      5'-NNNNNNNNNNNNNNNNNNNNGUUUUAGAGCUAUGCUGUUUUG-3'           (SEQ ID NO:50)
S. thermophilus  5'-NNNNNNNNNNNNNNNNNNNNGUUUUAGAGCUGUGUUGUUUCG-3'           (SEQ ID NO:51)
                    ********************* ****** ** ****** *

S. pyogenes      5'-GAACCAUUCAAAACAGCAUAGCAAGUUAAAAUAAGGC-UAGUCCGUUAUCAACUUGAAAAAGUGGCACCGAGUCGGUGCUUUUUUU-3' (SEQ ID NO:52)
S. thermophilus  5'------GGGCGAAACACACAGCGAGUUAAAAUAAGGCUUAGUCCGUACUCAACUGAAAAAGUUGCACCGAUUCGGUGCUUUUU---3' (SEQ ID NO:53)
                       * ***  ** *** ****  ************ *********  ********** ****** ****** ****

S. pyogenes - cont
S. thermophilus - cont
```

Fig.1G

```
CLUSTAL format alignment by MAFFT (v7.058b)
                                                  *
SM        KKPYSIGLDIGTNSVGWAVTTDDYKVPAKKMKVLGNTDKSHIEKNLLGALLFDSGNTAED
SP        DKKYSIGLDIGTNSVGWAVITDEYKVPSKKFKVLGNTDRHSIKKNLIGALLFDSGETAEA
ST        TKPYSIGLDIGTNSVGWAVTTDNYKVPSKKMKVLGNTSKKYIKKNLLGVLLFDSGITAEG
LI        KKPYTIGLDIGTNSVGWAVLTDQYDLVKRKMKIAGDSEKKQIKKNFWGVRLFDEGQTAAD
           * *:*  ************ **:**:  :****:  :::::  * *. *** . **
Motif:    --K-Y*-IGLDIGTNSVGWAV-TD*Y--*--*K*K--G*---*--I*KN*--G--LFD-G-TA--

SM        RRLKRTARRRYTRRRNRILYLQEIFSEEMGKVDDSFFHRLEDSFLVTEDKRGERHPIFGN
SP        TRLKRTARRRYTRRKNRICYLQEIFSNEMAKVDDSFFHRLEESFLVEEDKKHERHPIFGN
ST        RRLKRTARRRYTRRRNRILYLQEIFSTEMATLDDAFFQRLDDSFLVPDDKRDSKYPIFGN
LI        RRMARTARRRIERRRNRISYLQGIFAEEMSKTDANFFCRLSDSFYVDNEKRNSRHPFFAD
          *: ******* ** *** *** **  ** *. **.   * ****. ::*:. ::*:
Motif:    --R*--RTARRR--RR*NRI--YLQ--IF**--EM----D---FF--RL--*SF-V--*K*---*-*P*F---

SM        LEEEVKYHENFPTIYHLRQYLADNPEKVDLRLVYLALAHIIKFRGHFLIEGKFDTRNNDV
SP        IVDEVAYHEKYPTIYHLRKKLVDSTDKADLRLIYLALAHMIKFRGHFLIEGDLNPDNSDV
ST        LVEEKAYHDEFPTIYHLRKYLADSTKKADLRLVYLALAHMIKYRGHFLIEGEFNSKNND-
LI        IEEEVEYHKNYPTIYHLREELVNSSEKADLRLVYLALAHIIKYRGNFLIEGALDTQNTSV
           : *  **:. ..*:**** . : ..: *****.*****:**:*.:**** : . ..:
Motif:    *-*-*E--YH-**-*PTIYHLR*-L-*---K-DLRL*YLALAH*IK*RGNFLIEG-**--N--*
```

Fig. 2A

```
SM      QRLFQEFLAVYDNTFENSS------LQEQNVQVEEILTDKISKSAKKDRVLKLFPNEKSN
SP      DKLFIQLVQTYNQLFEENP------INASGVDAKAILSARLSKSRRLENLIAQLPGEKKN
ST      QKNFQDFLDTYNAIFESDL------SLENSKQLEEIVKDKISKLEKKDRILKLFPGEKNS
LI      DGIYKQFIQTYNQVFASGIEDGSLKKLEDNKDVAKILVEKVTRKEKLERILKLYPGEKSA
         :  :.  :**.:** : :       .         *:    :  :  : :    . **. 
Motif:  *--F-*----Y*---f------------------*----I*---*---*-*------P-EK--

SM      GRFAEFLKLIVGNQADFKKHFELEEKAPLQFSKDTYEEELEVLLAQIGDNYAELFLSAKK
SP      GLFGNLIALSLGLTPNFKSNFDLAEDAKLQLSKDTYDDDLDNLLAQIGDQYADLFLAAKN
ST      GIFSEFLKLIVGNQADFRKCFNLDEKASLHFSKESYDEDLETLLGYIGDDYSDVFLKAKK
LI      GMFAQFISLIVGSKGNFQKPFDLIEKSDIECAKDSYEEDLESLLALIGDEYAELFVAAKN
        * .:.::  :.*.: :*:: *:  *.   : *::::::* ** *  ***:*::**.:*:
Motif:  G-F-****-L-*G----*F*---F*L-E-*----*KY*L*-LL--IGD*Y***F*-AK*

SM      LYDSILLSGILTVTDVGTKAPLSASMIQRYNEHQMDLAQLKQFIRQKLSDKYNEVFSDVS
SP      LSDAILLSDILRVNTEITKAPLSASMIKRYDEHHQDLTLLKALVRQQLPEKYKEIFFDQS
ST      LYDAILLSGFLTVTDNETEAPLSSSAMIKRYNEHKEDLALLKEYIRNISLKTYNEVFKDDT
LI      AYSAVVLSSIITVAETETNAKLSASMIERFDTHEEDLGELKAFIKLHLPKHYEEIFSNTE
         *.: :**   *   :  .  *:.*: *:: *  **  **:*: :* *  *  :* :
Motif:  ---***LS-**-V----T*A-LS*--*MI*R**-H--DL--LK--**-------Y*E*F*---

SM      KDGYAGYIDGKTNQEAFYKYLKGLLNKIEGSGYFLDKIEREDFLRKQRTFDNGSIPHQIH
SP      KNGYAGYIDGGASQEEFYKFIKPILEKMDGTEELLVKLNREDLLRKQRTFDNGSIPHQIH
ST      KNGYAGYIDGKTNQEDFYVYLKKLLAEFEGADYFLEKIDREDFLRKQRTFDNGSIPYQIH
LI      KHGYAGYIDGKTKQADFYKYMKMTLENIEGADYFIAKIEKENFLRKENFLRKQRTFDNGAIPHQLH
        *::********  :  **  :     :  .   :  :::: :****: *******:**:**:*
Motif:  K-GYAGYIDG-*--Q--FY-*K--L-**G*---*-KELRKQRTFDNG*IP*Q*H
```

Fig. 2B

```
SM      LQEMRAIIRRQAEFYPFLADNQDRIEKLLTFRIPYYVGPLARGKSDFAWLSRKSADKITP
SP      LGELHAILRRQEDFYPFLKDNREKIEKILTFRIPYYVGPLARGNSRFAWMTRKSEETITP
ST      LQEMRAILDKQAKFYPFLAKNKERIEKILTFRIPYYVGPLARGNSDFAWSIRKRNEKITP
LI      LEELEAILHQQAKYYPFLKENYDKIKSLVTFRIPYFVGPLANGQSEFAWLTRKADGEIRP
        * *::.**:   :* . ::.:***  .:*..::*****.:**  *  ***  **   *  *
Motif:  L-E*-AI*--*Q--*YPFL--N-**I*-**TFRIPY*VGPLA-G*S-FAW--RK----I-P SM      WNFDEIVDKESSAEAFINRMTNYDLYLPNQKVLPKHSLLYEKFTVYNELTKVKYKTE-QG
SP      WNFEEVVDKGASAQSFIERMTNFDKNLPNEKVLPKHSLLLYEYFTVYNELTKVKYVTEGMR
ST      WNFEDVIDKESSAEAFINRMTSFDLYLPEEKVLPKHSLLYETFNVYNELTKVRFIAESMR
LI      WNIEEKVDFGKSAVDFIEKMTNKDTYLPKENVLPKHSLCYQKYLVYNELTKVRYIND-QG
        ** : :*  .:: *:*   **. *  **: ******* *:  ********: :     :
Motif:  WN*****-*D---SA--FI**MT---D--LP***VLPKHSL-Y*-*-VYNELTKV*----*-

SM      KTAFFDANMKQEIFDGVFKVYRKVTKDKLMDFLEKEFDEFRIVDLTGLDKENKVFNASYG
SP      KPAFLSGEQKKAIVDLLFKTNRKVTVKQLKEDYFKKIECFDSVEISGVEDR---FNASLG
ST      DYQFLDSKQKKDIVRLYFKDKRKVTDKDIIEYL-HAIYGYDGIELKGIEKQ---FNSSLS
LI      KTSYFSGQEKEQIFNDLFKQKRKVKKKDLELFL-RNMSHVESPTIEGLEDS---FNSSYS
           : *:   :* .  :  **  ** ***          . .:  . *:.     :  .
Motif:  ----*-*-K*-I---FK--RKV----*--------*--G**-----*-FN*S--.

SM      TYHDLCKIL-DKDFLDNSKNEKILEDIVLTLTLFEDREMIRKRLENYSDLLTKEQVKKLE
SP      TYHDLLKIIKDKDFLDNEENEDILEDIVLTLTLFEDREMIEERLKTYAHLFDDKVMKQLK
ST      TYHDLLNIINDKEFLDDSSNEAIIEEIIHTLTIFEDREMIKQRLSKFENIFDKSVLKKLS
LI      TYHDLLKVGIKQEILDNPVNTEMLENIVKILTVFEDKRMIKEQLQQFSDVLDGVVLKKLE
        *****    :  ::**  .** :: :*  **:**: **   *:   ::: . *: *
Motif:  TYHDL-**-----***LD*--N--**E*I*---LT*FED*-MI-**L*---*------*K*-L-
```

Fig. 2C

```
SM          RRHYTGWGRLSAELIHGIRNKESRKTTILDYLIDDGNSNRNFMQLINDDALSFKEEIAKAQ
SP          RRRYTGWGRLSRKLINGIRDKQSGKTILDFLKSDGFANRNFMQLIHDDSLTFKEDIQKAQ
ST          RRHYTGWGKLSAKLINGIRDEKSGNTILDYLIDDGISNRNFMQLIHDDALSFKKKIQKAQ
LI          RRHYTGWGRLSAKLLMGIRDKQSHLTILDYLMNDDGLNRNLMQLINDSNLSFKSIIEKEQ
            **:********  *:  ***::**   ****:*  *  *.   *.*:***:***:*.   *
Motif:      RR*YTGWG*LS-*L*-GIR***S--TILD*L--D---NRN*MQLI*D--L*FK--I-K-Q SM          VIGETD--NLNQVVSDIAGSPAIKKGILQSLKIVDELVKIMG--HQPENIVVEMARENQFT
SP          VSGQGD--SLHEHIANLAGSPAIKKGILQTVKVVDELVKVMGRHKPENIVIEMARENQTT
ST          IIGDEDKGNIKEVVKSLPGSPAIKKGILQSIKIVDELVKVMGGRKPESIVVEMARENQYT
LI          VTTADK--DIQSIVADLAGSPAIKKGILKKGILQSLKIVDELVSVMG--YPPQTTVVEMARENQTT
            :            .     :**:******  :**   *:******.:*:*     **:*******  *
Motif:      *-------*--*-GSPAIKKGILQ**K*VDELV-*MG--*P*-TV*EMARENQ-T SM          NQGRRNSQQRLKGLTDSIKEFGSQILKEH------PVENSQLQNDRLFLYYLQNGRDMYT
SP          QKGQKNSRERMKRIEEGIKELGSQILKEH------PVENTQLQNEKLYLYLYLQNGRDMYV
ST          NQGKSNSQQRLKRLEKSLKELGSKILKENIPAKLSKIDNNALQNDRLYLYLYLQNGKDMYT
LI          GKGKNNSRPRYKSLEKAIKEFGSQILKEH------PTDNQELRNNRLYLYYLQNGKDMYT
            :*  . *:.  : .:.   :.****:**:                 *:    *  **:* **:****:***.
Motif:      -*G--NS*-R-K-*---*KE*GS*ILKE*------*N--L*N**L*LYYLQNG*DMY-.

SM          GEELDIDYLSQYDIDHIIPQAFIKDNSIDNRVLTSSKENRGKSDDVPSKDVVRKMKSYWS
SP          DQELDINRLSDYDVDHIVPQSFLKDDSIDNKVLTRSDNKNRGKSDNVPSEEVVKKMKNYWR
ST          GDDLDIDRLSNYDIDHIIPQAFLKDNSIDNKVLVSSASNRGKSDDVPSLEVVKKRKTFWY
LI          GQDLDIHNLSNYDIDHIVPQSFITDNSIDNLVLTSSAGNREKGDDVPPLEIVRKRKVFWE
            . :**:  **: **:***:**:*: *:***  **  *. **:*.** **  *:*  * *  .
Motif:      -**LDI--LS*YD*DHI*PQ*F*-D*SIDN-VL--S--NR-K-D*VP---*V*-K--K-*W-

Fig. 2D
```

```
SM   KLLSAKLIITQRKFDNLTKAERGGLTDDDKAGFIKRQLVETRQITKHVARILDERFNTETD
SP   QLLNAKLIITQRKFDNLTKAERGGLSELDKAGFIKRQLVETRQITKHVAQILDSRMNTKYD
ST   QLLKSKLISQRKFDNLTKAERGGLSPEDKAGFIQRQLVETRQITKHVARLLDEKFNNKKD
LI   KLYQGNLMSKRKFDYLTKAERGLTEADKARFIHRQLVETRQITKNVANILHQRFNYEKD
     :*..:*::.:::**** ********:.  *** .*::******:***.:**.:.:: *
Motif: *L---*-*L***RKFD-LTKAERGL*---DKA-FI*RQLVETRQITK*VA-*L---**N-*-D SM   ENNKKIRQVKIVTLKSNLVSNFRKEFELYKVREINDYHHAHDAYLNAVIGKALLGVYPQL
SP   ENDKLIREVKVITLKSKLVSDFRKDFQFYKVREINNYHHAHDAYLNAVVGTALIKKYPKL
ST   ENNRAVRTVKIITTLKSTLVSQFRKDFELYKVREINDFHHAHDAYLNAVVASALLKKYPKL
LI   DHGNTMKQVRIVTLKSALVSQFRKQFQLYKVRDVNDYHHAHDAYLNGVVANTLLKVYPQL
     :.:. :::.**:** ***.:*** *: ****::*:* ******:..*:.:** :**:*
Motif: *-----V*TLKS-LVS*FRK*FLYKVN**HHAHDAYLN-V*---*L--*YP-*L SM   EPEFVYGDYPHFHGHKE------NK-ATAKKFFYSNIMNFFKKDDVRTD----------
SP   ESEFVYGDYKVYDVRKMIAKSEQEIGK-ATAKYFFYSNIMNFFKTEITLANGEIRKRPLI
ST   EPEFVYGDYPKYNSFRE------RKSATEKVYFYSNIMNIFKKSISLADGRVIERPLI
LI   EPEFVYGDYHQFDWFKA------NK-ATAKQFYTNIMLFFAQKDRIID----------
     *.******* .   :*      .* **:* :*:***:*: :                
Motif: E-EFVYGDY--*----*-------K-AT-K--FY*NIM--*F------*---------

SM   --KNGEIIWKKDEHISNIKKVLSYPQVNIVKKVEEQTGGFSKE----------SILPK
SP   ETNGETGEIVWDKGRDFATVRKVLSMPQVNIVKKTEVQTGGFSKE---------SILPK
ST   EVNEETGESVWNKESDLATVRRVLSYPQVNVVKKVEEQNHGLDRGKPKGLFNANLSSKPK
LI   ---ENGEILWDK-KYLDTVKKVMSYRQMNIVKKTEIQKGEFSKA-----------TIKPK
     :   *. :*:   . *:*::**:  *:*:***.*    *:            :  **
Motif: ----*--GE-*W--K----*----**V*M--Q*N*VKK--E-Q----*-------*--PK
```

Fig. 2E

| SM | GNSDK-LIPRKTKKFYWDTKKYGGGFDSPIVAYSILVIADIEKGKSKKLLKTVKALVGVTIM |
| SP | RNSDK-LIARKKD---WDPKKYGGFDSPTVAYSVLVVAKVEKGKSKKLKSVKELLGITIM |
| ST | PNSNENLVGAKEY---LDPKKYGGYAGISNSFTVLVKGTIEKGAKKKITNVLEFQGISIL |
| LI | GNSSK-LIPRKTN---WDPMKYGGLDSPNMAYAVVI--EYAKGKN-KLVFEKKIIRVTIM |
| | **.*:*: .*  . ****  .   :::::::  .  :::  .   ::*:        |
| Motif: | -NS-*-L*--K----D--KYGG-----*****----KG--K*----**I* |

| SM | EKMTFERDPVAFLERKGYRNVQEENIIKLPKYSLFKLENGRKRLLAS------ARELQK |
| SP | ERSSFEKNPIDFLEAKGYKEVKKDLIIKLPKYSLFELENGRKRMLAS------AGELQK |
| ST | DRINYRKDKLNFLLEKGYKDI--ELIIELPKYSLFELSDGSRRMLASILSTNNKRGEIHK |
| LI | ERKAFEKDEKAFLEEQGYRQP--KVLAKLPKYTLYECEEGRRRMLAS------ANEAQK |
| | ::  :::..**  :**::   . .: ****:*::  . :*          *  :.* |
| Motif: | *--*-*-**--FL-*GY**----*-*LPKY*L**----*G-*R*LAS------E-*K |

| SM | GNEIVLPNHLGTLLYHAKNIHKV-----DEPKHLDYVDKHDEFKELLDVVSNFSKKYT |
| SP | GNELALPSKYVNFLYLASHYEKLKGSPEDNEQKQL-FVEQHKHYLDEIIEQISEFSKRVI |
| ST | GNQIFLSQKFVKLLYHAKRISNT------INENHRKYVENHKKEFEELFYILEFNENYV |
| LI | GNQQVLPNHLVTLLHHAANCEVS------DGKSLDYIESNREMFAELLAHVSBFAKRYT |
| | **:  *.   :::  *        .      . :  :: ::** :  :  ::  |
| Motif: | GN*--L--*----*L*-A---------------**-.*-*-E***--*-*F--- |

| SM | LAEGNLEKIKELYAQNNGEDLKELASSFI----------NLLTFTAIGAPATFKFFDKNIDR |
| SP | LADANLDKVLSAYNKHRDKPIREQAENII----------HLFTLTNLGAPAAFKYFDTTIDR |
| ST | GAKKNGKLLNSAFQSWQNHSIDELCSSFIGPTGSERKGLFELTSRGSAADFEFLGVKIPR |
| LI | LAEANLNKINQLFEQNKEGDIKAIAQSFV----------DLMAFNAMGAPASFKFFETTIER |
| | *.   *  : .:*  ..       ***          . *    *.*.*:  :  *   |
| Motif: | -A--N---*---------*-------**-----------L-*----G*-A-F***--I-R |

Fig. 2F

```
SM  KR-YTSTTEILNATLIHQSITGLYETRIDLNKLGGD    (SEQ ID NO:1)
SP  KR-YTSTKEVLDATLIHQSITGLYETRIDLSQLGGD    (SEQ ID NO:2)
ST  YRDYTPSSLLKDATLIHQSVTGLYETRIDLAKLGEG    (SEQ ID NO:3)
LI  KR-YNNLKELLNSTIIYQSITGLYESRKRLD----D    (SEQ ID NO:4)
     *  *    ::  .:  ***:*******:..*

Motif: -R-Y------***T*I*QS*TGLYE*R--L------
```

Fig. 2G

Alignment of the N terminal RucV-like Domains disclosed in Chylinski et al.
(excluding sequence outliers).
(CLUSTAL format alignment by MAFFT (v7.058b))

```
 1   DIGTNSVGWAVT  (SEQ ID NO:54)
12   DIGTNSVGWAVT  (SEQ ID NO:55)
 3   DVGTNSVGWAVT  (SEQ ID NO:56)
20   DVGTNSVGWAVT  (SEQ ID NO:57)
15   DMGTNSVGWAVT  (SEQ ID NO:58)
 4   DVGTSSVGWAVT  (SEQ ID NO:59)
 7   DIGTASVGWAVT  (SEQ ID NO:60)
 6   DVGTGSVGWAVT  (SEQ ID NO:61)
 9   DVGTSVGWAVV   (SEQ ID NO:62)
10   DIGTNSVGWAVI  (SEQ ID NO:63)
11   DIGTNSVGWAVL  (SEQ ID NO:64)
42   DLGTNSVGWAVV  (SEQ ID NO:65)
48   DLGTNSIGWAI-  (SEQ ID NO:66)
43   DLGTNSIGWALV  (SEQ ID NO:67)
 2   DIGTNSVGWCVT  (SEQ ID NO:68)
14   DIGTNSVGYAVT  (SEQ ID NO:69)
 5   DMGTGSLGWAVT  (SEQ ID NO:70)
16   DIGTSSVGWAAI  (SEQ ID NO:71)
 8   DLGTGSVGWAVV  (SEQ ID NO:72)
22   DLGVGSVGWAIV  (SEQ ID NO:73)
23   DLGIASIGWAII  (SEQ ID NO:74)
24   DLGIASVGWAIV  (SEQ ID NO:75)
25   DLGVASVGWSIV  (SEQ ID NO:76)
26   DLGIASVGWAIL  (SEQ ID NO:77)
28   DLGISSVGWSVI  (SEQ ID NO:78)
32   DLGIASVGWSVI  (SEQ ID NO:79)
33   DLGIASVGWAVI  (SEQ ID NO:80)
39   DVGIGSIGWAVI  (SEQ ID NO:81)
34   DLGVGSIGFAIV  (SEQ ID NO:82)
47   DIGYASIGWAVI  (SEQ ID NO:83)
50   DTGTNSLGWAIV  (SEQ ID NO:84)
49   DLGTNSIGWCLL  (SEQ ID NO:85)
18   DIGTDSLGWAVF  (SEQ ID NO:86)
41   DIGSNSIGFAVV  (SEQ ID NO:87)
45   DLGVGSIGVAVA  (SEQ ID NO:88)
     DLGIASCGWGVV
```

Fig. 3A

| | | |
|---|---|---|
| 21 | DLGIASVGWCLT | (SEQ ID NO:89) |
| 27 | DIGIGSVGVGIL | (SEQ ID NO:90) |
| 29 | DIGITSVGYGLI | (SEQ ID NO:91) |
| 30 | DIGITSVGFGII | (SEQ ID NO:92) |
| 31 | DVGITSTGYAVL | (SEQ ID NO:93) |
| 40 | DLGITSFGYAIL | (SEQ ID NO:94) |
| 17 | DIGNASVGWSAF | (SEQ ID NO:95) |
| 19 | DVGTNSCGWVAM | (SEQ ID NO:96) |
| 35 | DVGERSIGLAAV | (SEQ ID NO:97) |
| 36 | DVGLNSVGLAAV | (SEQ ID NO:98) |
| 37 | DVGLMSVGLAAI | (SEQ ID NO:99) |
| 38 | DVGTFSVGLAAI | (SEQ ID NO:100) |
| 13 | DIGTGSVGYACM | (SEQ ID NO:101) |
| 44 | DLGTTSIGFAHI | (SEQ ID NO:102) |
| 46 | DLGTNSIGSSVR | (SEQ ID NO:103) |
| | * * * * | |

Fig. 3B

Alignment of the N terminal RucV-like Domains disclosed in Chylinski *et al.*
(CLUSTAL format alignment by MAFFT (v7.058b))

```
1           D----IGTNSVGWAVT        (SEQ ID NO:104)
12          D----IGTNSVGWAVT        (SEQ ID NO:105)
3           D----VGTNSVGWAVT        (SEQ ID NO:106)
20          D----VGTNSVGWAVT        (SEQ ID NO:107)
15          D----MGTNSVGWAVT        (SEQ ID NO:108)
4           D----VGTSSVGWAVT        (SEQ ID NO:109)
7           D----IGTASVGWAVT        (SEQ ID NO:110)
6           D----VGTGSVGWAVT        (SEQ ID NO:111)
9           D----IGTNSVGWAVV        (SEQ ID NO:112)
10          D----IGTNSVGWAVI        (SEQ ID NO:113)
52          D----IGTNSIGWAVI        (SEQ ID NO:114)
11          D----IGTNSVGWAVL        (SEQ ID NO:115)
42          D----LGTNSIGWAVV        (SEQ ID NO:116)
48          D----LGTNSIGWAI-        (SEQ ID NO:117)
43          D----LGTNSIGWALV        (SEQ ID NO:118)
2           D----IGTNSVGWCVT        (SEQ ID NO:119)
14          D----IGTNSVGYAVT        (SEQ ID NO:120)
5           D----MGTGSLGWAVT        (SEQ ID NO:121)
16          D----IGTSSVGWAAI        (SEQ ID NO:122)
8           D----LGTGSVGWAVV        (SEQ ID NO:123)
22          D----LGVGSVGWAIV        (SEQ ID NO:124)
23          D----LGIASIGWAII        (SEQ ID NO:125)
24          D----LGIASVGWAIV        (SEQ ID NO:126)
68          D----LGIASVGWAVV        (SEQ ID NO:127)
25          D----LGVASVGWSIV        (SEQ ID NO:128)
26          D----IGIASVGWAIL        (SEQ ID NO:129)
66          D----IGIASVGWAVL        (SEQ ID NO:130)
59          D----IGIASIGWAVI        (SEQ ID NO:131)
61          D----IGIASVGWAII        (SEQ ID NO:132)
64          D----VGIASVGWAVI        (SEQ ID NO:133)
62          D----IGIASVGWAL-        (SEQ ID NO:134)
67          D----IGIASVGWAMV        (SEQ ID NO:135)
32          D----IGIASVGWSVI        (SEQ ID NO:136)
28          D----LGISSVGWSVI        (SEQ ID NO:137)
63          D----IGITSVGWAVI        (SEQ ID NO:138)
```

Fig. 4A

| | | | |
|---|---|---|---|
| 33 | D----VGIGSIGWAVI | (SEQ ID NO:139) |
| 57 | D----LGISSLGWAIV | (SEQ ID NO:140) |
| 39 | D----LGVGSIGFAIV | (SEQ ID NO:141) |
| 34 | D----LGYASIGWAVI | (SEQ ID NO:142) |
| 50 | D----LGTNSIGWCLL | (SEQ ID NO:143) |
| 54 | D----LGTNSIGWGLL | (SEQ ID NO:144) |
| 47 | D----TGTNSLGWAIV | (SEQ ID NO:145) |
| 49 | D----IGTDSLGWAVF | (SEQ ID NO:146) |
| 51 | D----LGSTSLGWAIF | (SEQ ID NO:147) |
| 58 | D----LGISSIGWAFS | (SEQ ID NO:148) |
| 21 | D----LGIASVGWCLT | (SEQ ID NO:149) |
| 45 | D----LGIASCCWGVV | (SEQ ID NO:150) |
| 18 | D----IGSNSIGFAVV | (SEQ ID NO:151) |
| 65 | D----IGTTSIGFSVI | (SEQ ID NO:152) |
| 29 | D----IGITSVGYGLI | (SEQ ID NO:153) |
| 30 | D----IGITSVGFGII | (SEQ ID NO:154) |
| 44 | D----LGTTSIGFAHI | (SEQ ID NO:155) |
| 27 | D----IGIGSVGVGIL | (SEQ ID NO:156) |
| 41 | D----LGVGSIGVAVA | (SEQ ID NO:157) |
| 31 | D----VGITSTGYAVL | (SEQ ID NO:158) |
| 40 | D----LGITSFGYAIL | (SEQ ID NO:159) |
| 53 | D----LGTSSIGWWLY | (SEQ ID NO:160) |
| 55 | D----LGSNSLGWFVT | (SEQ ID NO:161) |
| 56 | D----LGANSLGWFVV | (SEQ ID NO:162) |
| 17 | D----IGNASVGWSAF | (SEQ ID NO:163) |
| 19 | D----VGTNSCGWVAM | (SEQ ID NO:164) |
| 35 | D----VGERSIGLAAV | (SEQ ID NO:165) |
| 36 | D----VGLNSVGLAAV | (SEQ ID NO:166) |
| 37 | D----VGLMSVGLAAI | (SEQ ID NO:167) |
| 38 | D----VGTFSVGLAAI | (SEQ ID NO:168) |
| 13 | D----IGTGSVGYACM | (SEQ ID NO:169) |
| 46 | D----LGTNSIGSSVR | (SEQ ID NO:170) |
| 60 | DIGLRIGITSCGWSI- | (SEQ ID NO:171) |
| 69 | D----MGAKYTGVFYA | (SEQ ID NO:172) |
| 73 | D----LGGKNTGFFSF | (SEQ ID NO:173) |
| 74 | D----LGVKNTGVFSA | (SEQ ID NO:174) |
| 70 | D----LGAKFTGVALY | (SEQ ID NO:175) |
| 71 | D----LGGKFTGVCLS | (SEQ ID NO:176) |
| 72 | D----LGGTYTGTFIT | (SEQ ID NO:177) |
| | * * * | |

Fig. 4B

Alignment of the HNH-like Domains disclosed in Chylinski et al.
(CLUSTAL format alignment by MAFFT (v7.058b))

```
 1   YDIDHIYPRS-LTKD------DSF-DNLVLCERTAN   (SEQ ID NO:178)
 2   -DIDHIYPRSKVIKD------DSF-DNLVLVLKNEN   (SEQ ID NO:179)
 3   -DRDHIYPQS-KIKD------DSI-DNLVLVNKTYN   (SEQ ID NO:180)
 4   -DIDHIYPRS-KIKD------DSI-TNRVLVEKDIN   (SEQ ID NO:181)
 6   -DIDHIYPQS-KIKD------DSI-SNRVLVCSSCN   (SEQ ID NO:182)
 5   -DIDHIYPQS-KTMD------DSL-NNRVLVKKNYN   (SEQ ID NO:183)
 7   -DQDHIYPKS-KIYD------DSL-ENRVLVKKNLN   (SEQ ID NO:184)
 8   -QIDHIYPQS-LVKD------DSF-DNRVLVVPSEN   (SEQ ID NO:185)
 9   -DIDHIIPQA-FIKD------NSI-DNRVLTSSKEN   (SEQ ID NO:186)
12   -DIDHIIPQA-FLKD------NSI-DNKVLVSSASN   (SEQ ID NO:187)
16   -DIDHIIPQA-YTKD------NSL-DNRVLVSNITN   (SEQ ID NO:188)
11   -DIDHIVPQS-FITD------NSI-DNLVLTSSAGN   (SEQ ID NO:189)
10   -DVDHIVPQS-FLKD------DSI-DNKVLTRSDKN   (SEQ ID NO:190)
14   -NIDHIYPQS-MVKD------DSI-DNKVLVQSEIN   (SEQ ID NO:191)
18   -DIDHILPQS-LIKD------DSL-DNRVLVNATIN   (SEQ ID NO:192)
19   -DIDHILPQS-FIKD------DSL-ENRVLVKKAVN   (SEQ ID NO:193)
13   -DIDHILPQS-FIKD------DSI-DNKVLVIKKMN   (SEQ ID NO:194)
15   -EVDHIFPRS-FIKD------DSF-ENKVLVYREEN   (SEQ ID NO:195)
17   -EVDHIIPRS-YIKD------DSI-DNRVLVARAEN   (SEQ ID NO:196)
22   -DIDHIIPQA-VTQN------DSS-SNKLLVLAESN   (SEQ ID NO:197)
24   -EIDHIIPYS-ISFD------DSS-ANKVLVHKQSN   (SEQ ID NO:198)
32   -DIDHIIPYS-LCFD------DSY-SNKVLVLSGEN   (SEQ ID NO:199)
63   -DIDHIIPYS-RSMD------DSF-NNKVLCLAREN   (SEQ ID NO:200)
59   -EIDHIYPYS-RSFD------DSY-MNKVLVFTKQN   (SEQ ID NO:201)
65   -QIDHIYPYS-RSMD------DSY-MNKVLVLTDEN   (SEQ ID NO:202)
64   -EIDHIIPFS-RSFD------DSL-SNKILVLGSEN   (SEQ ID NO:203)
68   -EIDHALPFS-RTWD------DSF-NNKVLVLGSEN   (SEQ ID NO:204)
69   -EIDHALPFS-RTWD------DSF-NNKVLVLASEN   (SEQ ID NO:205)
28   -EIDHIIPIS-ISLD------DSI-NNKVLVLSKAN   (SEQ ID NO:206)
30   -EVDHIIPIS-ISLD------DSI-TNKVLVTHREN   (SEQ ID NO:207)
62   -QVDHALPYS-RSYD------DSK-NNKVLVLTHEN   (SEQ ID NO:208)
27   -EVDHILPLS-ITFD------DSL-ANKVLVYATAN   (SEQ ID NO:209)
26   -EIDHIIPRS-ISFD------DAR-SNKVLVYRSEN   (SEQ ID NO:210)
```

Fig. 5A

| | | |
|---|---|---|
| 29 | -EVDHIIPRS-VSFD------NSY-HNKVLVKQSEN | (SEQ ID NO:211) |
| 67 | -DIDHILPYS-ITFD------DSF-RNKVLVTSQEN | (SEQ ID NO:212) |
| 58 | -EIDHILPRS-RSAD------DSF-ANKVLCLARAN | (SEQ ID NO:213) |
| 51 | -EIEHLLPFS-LTLD------DSM-ANKTVCFRQAN | (SEQ ID NO:214) |
| 55 | -DIDHILPFS-VSLD------DSA-ANKVVCLREAN | (SEQ ID NO:215) |
| 57 | -DIDHILPFS-ISWD------DSA-ANKVVCMRYAN | (SEQ ID NO:216) |
| 56 | -DIDHILPVA-MTLD------DSP-ANKIICMRYAN | (SEQ ID NO:217) |
| 54 | -DVDHILPYS-RTLD------DSF-PNRTLCLREAN | (SEQ ID NO:218) |
| 52 | -EIEHILPFS-RTLD------DSL-NNRTVAMRRAN | (SEQ ID NO:219) |
| 31 | -EVDHIIPYS-ISWD------DSY-TNKVLTSAKCN | (SEQ ID NO:220) |
| 45 | -QVDHILPWS-RFGD------DSY-LNKTLCTARSN | (SEQ ID NO:221) |
| 53 | -QIDHAFPLS-RSLD------DSF-ANKVLAQHDAN | (SEQ ID NO:222) |
| 60 | -QIDHAFPLS-KTLD------DSQ-SNKVLCLTSSN | (SEQ ID NO:223) |
| 21 | -DIDHIVPRS-ISFD------DSF-SNLVIVNKLDN | (SEQ ID NO:224) |
| 23 | -EIEHILPYS-MSYD------NSQ-ANKILTEKAEN | (SEQ ID NO:225) |
| 25 | -EIDHVIPYS-KSAD------DSW-FNKLLVKKSTN | (SEQ ID NO:226) |
| 49 | -EMDHILPYS-RSLD------NGW-HNRVLVHGKDN | (SEQ ID NO:227) |
| 33 | -EVDHIVPYS-LILD------NTI-NNKALVYAEEN | (SEQ ID NO:228) |
| 42 | -EIEHVIPQS-LYFD------DSF-SNKVICEAEVN | (SEQ ID NO:229) |
| 43 | -DIEHIIPQA-RLFD------DSF-SNKTLEARSVN | (SEQ ID NO:230) |
| 44 | -EIEHIVPKA-RVFD------DSF-SNKTLTFHRIN | (SEQ ID NO:231) |
| 20 | -DKDHIIPQS-MKKD------DSIINNLVLVNKNAN | (SEQ ID NO:232) |
| 66 | -EVEHIWPRS-RSFD------NSP-RNKTLCRKDVN | (SEQ ID NO:233) |
| 61 | -IVNHIIPYN-RSFD------DTY-HNRVLTLTETK | (SEQ ID NO:234) |
| 46 | -DMEHTIPKS-ISFD------NSD-QNLTLCESYYN | (SEQ ID NO:235) |
| 47 | -DIEHTIPRS-AGGD------STK-MNLTLCSSRFN | (SEQ ID NO:236) |
| 48 | -DIEHTIPRS-ISQD------NSQ-MNKTLCSLKFN | (SEQ ID NO:237) |
| 50 | -DIDHVIPLA-RGGR------DSL-DNMVLCQSDAN | (SEQ ID NO:238) |
| 39 | -DIEHLFPIA-ESED------NGR-NNLVISHSACN | (SEQ ID NO:239) |
| 41 | -DVDHIFPRD-DTAD------NSY-GNKVVAHRQCN | (SEQ ID NO:240) |
| 40 | -DIEHIVPQS-LGGL------STD-YNTIVTLKSVN | (SEQ ID NO:241) |
| 35 | -ELDHIVPRT-DGGS------NRH-ENLAITCGACN | (SEQ ID NO:242) |
| 36 | -EMDHIVPRKGVGST-----NTR-TNFAAVCAECN | (SEQ ID NO:243) |
| 37 | -EMDHIVPRKGVGST-----NTR-VNLAAACAACN | (SEQ ID NO:244) |
| 38 | -EMDHIVPRAGQGST-----NTR-ENLVAVCHRCN | (SEQ ID NO:245) |
| 70 | -EIDHILPRS-LIKDARGIVFNAE-PNLIYASSRGN | (SEQ ID NO:246) |
| 71 | -EIDHIIPRS-LTGRTKKTVFNSE-ANLIYCSSKGN | (SEQ ID NO:247) |
| 73 | -EIDHIIPRS-LTLKKSESIYNSE-VNLIFVSAQGN | (SEQ ID NO:248) |

Fig. 5B

```
72  -EIDHIYPRS-LSKKHFGVIFNSE-VNLIYCSSQGN     (SEQ ID NO:249)
74  -EIDHILPRS-HTLKIYGTVFNPE-GNLIYVHQKCN     (SEQ ID NO:250)
75  -ELDHIIPRS-HKKY---GTLNDE-ANLICVTRGDN     (SEQ ID NO:251)
34  -ELEHIVPHS-FRQS------NAL-SSLVLTWPGVN     (SEQ ID NO:252)
      :*        .             .
```

Fig. 5C

Alignment of the HNH-like Domains disclosed in Chylinski et al. (excluding sequence outliers).
(CLUSTAL format alignment by MAFFT (v7.058b))

```
1    YDIDHIYPRS-LTKDDS-FDNLVLCERTAN   (SEQ ID NO:253)
2    DIDHIYPRSKVIKDDS-FDNLVLVLKNEN    (SEQ ID NO:254)
3    DRDHIYPQS-KIKDDS-IDNLVLVNKTYN    (SEQ ID NO:255)
4    DIDHIYPRS-KIKDDS-ITNRVLVEKDIN    (SEQ ID NO:256)
6    DIDHIYPQS-KIKDDS-ISNRVLVCSSCN    (SEQ ID NO:257)
5    DIDHIYPQS-KTMDDS-LNNRVLVKKNYN    (SEQ ID NO:258)
7    DQDHIYPKS-KIYDDS-LENRVLVKKNLN    (SEQ ID NO:259)
8    QIDHIVPQS-LVKDDS-FDNRVLVVPSEN    (SEQ ID NO:260)
9    DIDHIIPQA-FIKDNS-IDNRVLTSSKEN    (SEQ ID NO:261)
12   DIDHIIPQA-FLKDNS-IDNKVLVSSASN    (SEQ ID NO:262)
16   DIDHIIPQA-YTKDNS-LDNRVLVSNITN    (SEQ ID NO:263)
11   DIDHIVPQS-FITDNS-IDNLVLTSSAGN    (SEQ ID NO:264)
10   DVDHIVPQS-FLKDDS-IDNKVLTRSDKN    (SEQ ID NO:265)
14   NIDHIYPQS-MVKDDS-LDNKVLVQSEIN    (SEQ ID NO:266)
18   DIDHILPQS-LIKDDS-LDNRVLVNATIN    (SEQ ID NO:267)
19   DIDHILPQS-FIKDDS-LENRVLVKKAVN    (SEQ ID NO:268)
13   EVDHIFPRS-FIKDDS-IDNKVLVIKKMN    (SEQ ID NO:269)
15   EVDHIIPRS-YIKDDS-FENKVLVYREEN    (SEQ ID NO:270)
17   DIDHIIPQA-VTQNDS-IDNRVLVARAEN    (SEQ ID NO:271)
21   DIDHIVPRS-ISFDDS-FSNLVIVNKLDN    (SEQ ID NO:272)
22   EIDHIIPYS-ISFDDS-SSNKLLVLAESN    (SEQ ID NO:273)
24   EIDHIIPYS-LCFDDS-SANKVLVHKQSN    (SEQ ID NO:274)
28   EIDHIIPIS-ISLDDS-INNKVLVLSKAN    (SEQ ID NO:275)
30   EVDHIIPIS-ISLDDS-ITNKVLVTHREN    (SEQ ID NO:276)
27   EVDHILPLS-ITFDDS-LANKVLVYATAN    (SEQ ID NO:277)
26   EIDHIIPRS-ISFDDA-RSNKVLVYRSEN    (SEQ ID NO:278)
29   EVDHIIPRS-VSFDNS-YHNKVLVKQSEN    (SEQ ID NO:279)
31   EVDHIIPYS-ISWDDS-YTNKVLTSAKCN    (SEQ ID NO:280)
32   DIEHIIPYS-RSMDDS-YSNKVLVLSGEN    (SEQ ID NO:281)
23   DIEHIIPYS-MSYDNS-QAMKILTEKAEN    (SEQ ID NO:282)
33   EVDHIVPYS-LILDNT-INNKALVYAEEN    (SEQ ID NO:283)
25   EIDHVIPYS-KSADDS-WFNKLLVKKSTN    (SEQ ID NO:284)
49   EMDHILPYS-RSLDNG-WHNRVLVHGKDN    (SEQ ID NO:285)
42   EIEHVIPQS-LYFDDS-FSNKVICEAEVN    (SEQ ID NO:286)
43   DIEHIIPQA-RLFDDS-FSNKTLEARSVN    (SEQ ID NO:287)
```

Fig. 6A

| | |
|---|---|
| 44 -EIEHIVPKA-RVFDDS-FSNKTLTFHRIN | (SEQ ID NO:288) |
| 20 -DKDHIIPQS-MKKDDSIINNLVLVNKNAN | (SEQ ID NO:289) |
| 45 -QVDHILPWS-RFGDDS-YLNKTLCTARSN | (SEQ ID NO:290) |
| 50 -DIDHVIPLA-RGGRDS-LDNMVLCQSDAN | (SEQ ID NO:291) |
| 46 -DMEHTIPKS-ISFDNS-DQNLTLCESYYN | (SEQ ID NO:292) |
| 47 -DIEHTIPRS-AGGDST-KMNLTLCSSRFN | (SEQ ID NO:293) |
| 48 -DIEHTIPRS-ISQDNS-QMNKTLCSLKFN | (SEQ ID NO:294) |
| 39 -DIEHLFPIA-ESEDNG-RNNLVISHSACN | (SEQ ID NO:295) |
| 41 -DVDHIFPRD-DTADNS-YGNKVVAHRQCN | (SEQ ID NO:296) |
| 40 -DIEHIVPQS-LGGLST-DYNTIVTLKSVN | (SEQ ID NO:297) |
| 35 -ELDHIVPRT-DGGSNR-HENLAITCGACN | (SEQ ID NO:298) |
| 36 -EMDHIVPRKGVGSTNT-RTNFAAVCAECN | (SEQ ID NO:299) |
| 37 -EMDHIVPRKGVGSTNT-RVNLAAACAACN | (SEQ ID NO:300) |
| 38 -EMDHIVPRAGQGSTNT-RENLVAVCHRCN | (SEQ ID NO:301) |
| 34 -ELEHIVPHS-FRQSNA-LSSLVLTWPGVN | (SEQ ID NO:302) |
  :* *          .            .  *

Fig. 6B

Sequence alignment between SpCas9 and NmCas9

```
NmCas9   MAAFKPNSINYILGLDIGIASVGWAMVEIDEEENPIRLID--------------LGVRVFE
SpCas9   ------MDKKYSIGLDIGTNSVGWAVITDEYKVPSKKFKVLGNTDRHSIKKNLIGALLFD
         ---------*Y-*GLDIG--SVGWA**--*-*----**--------------*G---*F*
NmCas9   RAEVPKTGDSLAMARRLARSVRRLTRRRAHRLLRTRRLLKREGVLQAA-------------
SpCas9   SGET-------AEATRLKRTARRRYTRRKNRICYLQEIFSNEMAKVDDSFFHRLEESFLV
         --E---------A-A-RL-R*-RR---RR--R*---*-**--E-----------------
NmCas9   ---------------NFDENGLIKSLPNTPWQLRAAALDRK---LTPLEWSAVLLHLIKHR
SpCas9   EEDKKHERHPIFGNIVDEVAYHEKYP-TIYHLRKKLVDSTDKADLRLI-YLALAHMIKFR
         ----------------DE----*--P-T **LR----*D---------L-----L-H*IK-R
NmCas9   GYLSQRKNE-------------------------------GETA----------DKEL---
SpCas9   GHFLIEGDLNPDNSDVDKLFIQLVQTYNQLFEENPINASGVDAKAILSARLSKSRRLENL
         G**----*--------------------------------G--A-----------*-L---
NmCas9   -----GALLKGVAGNAHALQTG---DFRTPAE------LAL--NKFEKESGHIRNQ-RSD
SpCas9   IAQLPGEKKNGLFGNLIALSLGLTPNFKSNFDLAEDAKLQLSKDTYDDDLDNLLAQIGDQ
         -----G---*G*-GN--AL--G---*F**---*------L-L--*-*-*----*--Q---*
NmCas9   YSHTFSR----------------------------------------------KDLQA
SpCas9   YADLFLAAKNLSDAILLSDILRVNTEITKAPLSASMIKRYDEHHQDLTLLKALVRQQLPE
         Y*--F-------------------------------------------------**L--
NmCas9   ELILLFEKQKEFGN-PHVSGGLK--------------EGIETL---------LMTQRPA
SpCas9   KYKEIFFDQSKNGYAGYIDGGASQEEFYKFIKPILEKMDGTEELLVKLNREDLLRKQRTF
         *----*F--Q-*-G---**-GG----------------*G-E-L---------L--QR--
NmCas9   LSGDAV-QKMLGH--------CTFEPAEP---------------KAAKNTYTAERPIWL
SpCas9   DNGSIPHQIHLGELHAILRRQEDFYPPLKDNREKIEKILTFRIPYYVGPLARGNSRFAWM
         --G----Q--LG----------F-P---------------------*----RF-W*
NmCas9   TKLNNLRILEQGSERPLTD-------TERATLMDEPY------RKSKLTYAQAR------
SpCas9   TRKSEETITPWNFEEVVDKGASAQSFIERMTNFDKNLPNEKVLPKHSLLYEYFTVYNELT
         T*--**--I-----E--*---------ER-T-*D*--------K--L-Y----------
NmCas9   ----KLLGLEDTAFFKGLRY--------GKDN-----------------------AEA
SpCas9   KVKYVTEGMRKPAFLSGEQKKAIVDLLFKTNRKVTVKQLKEDYFKKIECFDSVEISGVED
         ---------G*----AF*-G-*---------*----------------------E-
NmCas9   STLMEMKAYHAISRALEKEGLKDKKSPLNLSPELQDEIGTAFSLFKTDEDITGRLKDRIQ
SpCas9   RFNASLGTYHDLLKIIKDKDFLDNEE----NEDILEDIVLTLTLFEDREMIEERLKTYAH
         ------*-*YH-*-*-**-*-*-D**--------**-**I---***LF*--E-I--RLK---*
NmCas9   P--EILEALLKHISFDKFVQISLKALRRIVPLMEQGKRYDEACAE----IYGDHYGKKNT
SpCas9   LFDDKVMKQLKRRYTGWGRLSRKLI--------NGIRDKQSGKTILDFLKSDGFANRNF
         ---*-*---LK*--*--*-**S-K-*--------*G-R--**--------*--D-*-**N-
NmCas9   EEKI------Y------------LPPIPADEIRNPVVLRALSQARKVINGVVRRYG-
SpCas9   MQLIHDDSLTFKEDIQKAQVSGQGDSLHEHIANLAGSPAIKKGILQTVKVVDELVKVMGR
         -*-I------*-------------L----A*----P-*-*-*-Q*-KV**-*V*--G-
NmCas9   -SPARIHIETAREVGKSFKDRKEIEKRQEENRKDREKAAAKFREYFPNF----VGEPKSK
SpCas9   HKPENIVIEMARENQTTQKGQKNSRER-------MKRIEEGIKELGSQILKEHPVENTQL
         --P--I-IE-ARE---*-K-*K*--*R--------**----**E---**------E----
NmCas9   DILKLRLYEQQHGKCLYSGKEINLGRLNEKGYVEIDHALPFSRTWDDSFNNKVLVLGSEN
SpCas9   QNEKLYLYYLQNGRDMYVDQELDINRLSD---YDVDHIVPQSFLKDDSIDNKVLTRSDKN
         *--KL-LY--Q-G*-*Y--*E*** RL-*----**DH-*P-S---DDS**NKVL----*N
NmCas9   QNKGNQTPYEYFNGKDNSREWQEFKA-RVET-SRFP-RSKKQRILLQKFDEDGFKERNLN
SpCas9   RGKSDNVPSEEVVKKM-KNYWRQLLNAKLITQRKFDNLTKAERGGLSELDKAGFIKRQLV
         * K--P-E----K-----W*--**-T--*F----*K-*R--L-**D*-GF-*R*L-
```

Fig. 7A

```
NmCas9    DTRYVNRFLCQFVADRMRLTGKGKKRVF------ASNGQITNLLRGFWGLRKVRAENDR H
SpCas9    ETRQITKHVAQILDSRMNTKYDENDKLIREVKVITLKSKLVSDFRKDFQFYKVREINNY H
          *TR-*-*-*-Q**---RM------*-***------*-*-**---*R--*-*-KVR--N*-H
                                                                    B

NmCas9      HALDAVV WACSTVAMQQKI---TRFVRYKEMNAFDGKTID----KETGEVLHQKTHFPQP
SpCas9    B HAHDAYL NAVVGTALIKKYPKLESEFVYGDYKVYDVRKMIAKSEQEIGKATAKYFFYSNI
            HH-AD-* -A----A*-*K---------Y-*-*-*D-*-*-----*E-G*---*---*-*-

NmCas9    WEFFAQEVMIRVFGKPDGKPE-----------FEEADTLEKLRTLLAEKLSSRPEAVHEY
SpCas9    MNFFKTEITLA-NGEIRKRPLIETNGETGEIVWDKGRDFATVRKVLS-----MPQ-----
          -*FF--E*-*---G*----*P-----------***---*--R-*L*------P*-----

NmCas9    VTPLFVSRAPNRKMSGQGHMETVKSAKRLDEGVSVLRVPLTQLKLKDLEKMVN--REREP
SpCas9    -------------------VNIVKKTEVQTGGFSKES----ILPKRNSDKLIARKKDWDP
          --------------------VK-----G-S--------L--**-*K----*P

NmCas9    KLYEALKARLEAHKDDPAKAFAEPFYKYDKAGNRTQQVKAVR---VEQVQKTGVWVRNH-
SpCas9    KKYGGFD--------SPTVAYSVLVVAKVEKGK-SKKLKSVKELLGITIMERSSFEKNPI
          K-Y--*--------P*-A**--------*-G*-****K*V*------*-*---*-*N--

NmCas9    -----NGIAD-------------------NATMVRVDVFEKGDKYYLVPIY-------
SpCas9    DFLEAKGYKEVKKDLIIKLPKYSLFELENGRKRMLASAGELQKGNELALPSKYVNFLYLA
          -----*G--*---------------------*---*-----KG--L---Y-----

NmCas9    -SWQVAKGILPDRAVVQGKDEEDWQLIDDS------FNFKFSLHPNDLVEVI--------
SpCas9    SHYEKLKGSPEDNEQKQLFVEQHKHYLDEIIEQISEFSKRVILADANLDKVLSAYNKHRD
          --*--KG---D----Q---E*--*-*D*-------F--*--L---*L-*V*--------

NmCas9    -----------------TKKARMFGYFASCHRGTGNINIRIHDLDHKIGKNGILEGIGV
SpCas9    KPIREQAENIIHLFTLTNLGAPAAFKYFDTTIDRKRYTS-TKEVLDATLIHQSI------
          -----------------------F-YF-*--------------LD--*-**-I------

NmCas9    KTALSFQKYQIDELGKEIRPCRLKKRPPVR    (SEQ ID NO:6)
SpCas9    -TGLYETRIDLSQLGGD-------------    (SEQ ID NO:7)
          -T-L---*-**-*LG-*-------------
```

Percent Identity Matrix - created by Clustal2.1

Fig. 7B

Sequence of the NmCas9 ORF with dual NLS and HA tags

```
atg|gtgcctaagaagaagagaaaggtggc|tgccttcaaacctaattcaatcaactacatcctcggcctcgat
atcggcatcgcatccgtcggctgggcgatggtagaaattgacgaagaagaaaacccatccgcctgattgat
ttgggcgtgcgcgtatttgagcgtgccgaagtaccgaaaacaggcgactcccttgccatggcaaggcgtttg
gcgcgcagtgttcgccgcctgacccgccgtcgcgccaccgcctgcttcggacccgccgcctattgaaacgc
gaaggcgtattacaagccgccaattttgacgaaaacggcttgattaaatccttaccgaatacaccatggcaa
cttcgcgcagccgcattagaccgcaaactgacgcctttagagtggtcggcagtcttgttgcatttaatcaaa
catcgcggctatttatcgcaacggaaaaacgagggcgaaactgccgataaggagcttggcgctttgcttaaa
ggcgtagccggcaatgcccatgccttacagacaggcgatttccgcacaccggccgaattggcttaaataaa
tttgagaaagaaagcggccatatccgcaatcagcgcagcgattattcgcatacgttcagccgcaaagattta
caggcggagctgattttgctgtttgaaaaacaaaaagaatttggcaatccgcatgtttcaggcggccttaaa
gaaggtattgaaaccctactgatgacgcaacgccctgccctgtccggcgatgccgttcaaaaaatgttgggg
cattgcaccttcgaaccggcagagccgaaagccgctaaaaacacctacacagccgaacgtttcatctggctg
accaagctgaacaacctgcgtattttagagcaaggcagcgagcggccattgaccgataccgaacgcgccacg
cttatggacgagccatacagaaaatccaaactgacttacgcacaagcccgtaagctgctggtttagaagat
accgccttttcaaaggcttgcgctatggtaaagacaatgccgaagcctcaacattgatggaaatgaaggcc
taccatgccatcagccgtgcactggaaaaagaaggattgaaagacaaaaaatccccattaaacctttctccc
gaattacaagacgaaatcggcacggcattctccctgttcaaaaccgatgaagacattacaggccgtctgaaa
gaccgtatacagcccgaaatcttagaagcgctgttgaaacacatcagcttcgataagttcgtccaaatttcc
ttgaaagcattgcgccgaattgtgcctctaatggaacaaggcaaacgttacgatgaagctgcgccgaaatc
tacggagaccattacggcaagaagaatacgaagaaaagatttatctgccgccgattccgccgacgaaatc
cgcaacccccgtcgtcttgcgcgcctttatctcaagcacgtaaggtcattaacggcgtggtacgccgttacggc
tccccagctcgtatccatattgaaactgcaaggggaatgggtaaatcgttaaagaccgcaaagaaattgag
aaacgccaagaagaaaaccgcaaagaccggggaaaaagccgccgccaaattccgagagtattcccccaatttt
gtcggagaaccccaaatccaaagatattctgaaactgcgcctgtacgagcaacaacacgcgcaaatgcctgtat
tcgggcaaagaaatcaacttaggccgtctgaacgaaaaaggctatgtcgaaatcgaccatgccctgccgttc
tcgcgcacatgggacgacagtttcaacaataaagtactggtattgggcagcgaaaaccaaaacaaaggcaat
caaaccccttacgaatacttcaacggcaaagacaacagccgcgaatggcaggaatttaaagcgcgtgtcgaa
accagccgtttcccgcgcagtaaaaaacaacggattctgctgcaaaaattcgatgaagacggcttaaagaa
cgcaatctgaacgacacgcgctacgtcaaccgtttcctgtgtcaatttgttgccgaccgtatgcggctgaca
ggtaaaggcaagaaacgtgtctttgcatccaacgacaaattaccaatctgttgcgcggcttttggggattg
cgcaaagtgcgtgcggaaaacgaccgccatcacgccttggacgccgtcgtcgttgcctgctcgaccgttgcc
atgcagcagaaaattacccgttttgtacgctataaagagatgaacgcgtttgacggtaaaaccatagacaaa
gaaacaggagaagtgctgcatcaaaaaacacacttcccacaaccttgggaatttttcgcacaagaagtcatg
attcgcgtcttccgcaaaccggacggcaaaccgtcaaatcgaagaggccgataccctagaaaaaactgcgcacg
ttgcttgccgaaaattatcatctcgccccgaagccgtacacgaatacgttacgccactgtttgtttcacgc
gcgcccaatcggaagatgagcgggcaagggcatatggagaccgtcaaatccgccaaacgactggacgaaggc
gtcagcgtgttgcgcgtaccgctgacacagttaaaactgaaagacttggaaaaaatggtcaatcgggagcgc
gaacctaagctatacgaagcactgaaagcacggctggaagcacataaagacgatcctgccaaagcctttgcc
gagccgttttacaaatacgataaagcaggcaaccgcacccaacaggtaaaagccgtacgcgtagagcaagta
cagaaaaccggcgtatgggtgcgcaaccataaccggtattccgacaaccgaaccattggtgccgcgtagatgtg
tttgagaaaggcgacaagtatatctggtaccgatttacagttggcaggtagcgaaagggattttgccggat
agggctgttgtacaaggaaaagatgaagaagattggcaacttattgatagtttcaactttaaattctca
ttacacccctaatgatttagtcgaggttataacaaaaaaagctagaatgtttgttacttgccagctgccat
cgaggcacaggtaatatcaatatacgcattcatgatcttgatcataaaattggcaaaaatggaatactggaa
ggtatcggcgtcaaaaccgcccttcattccaaaaataccaaattgacgaactgggcaaagaaatcagacca
tgccgtctgaaaaaacgcccgcctgtccgt|tacccatacgatgttccagattacgct|gcagctccagcagcg
|aagaaaaagaagctggat|taa                     (SEQ ID NO:303)
                                G                          O
```

R: SV40 NLS, G: HA tag, O: synthetic NLS (1); all else NmCas9

Fig. 8

```
ttggccactccctctctgcgcgctcgctcgctcactgaggccgggcgaccaaaggtcgcccgacgcccgggctttgcccggcggcctcagtgagcgagcgagcgcg
aaccggtgagggagagacgcgcgagcgagcgagtgactccggcccgctggttccagcgggctgcgggcccgaaacgggcccgccggagtcactcgctcgctcgcgc
```
────────────── LeftITR ──────────────
```
     20          40          60          80          100
```

```
cagagagggagtggccaactccatcactaggggttcctcagatctgaattcggtaccaaggtcgggcaggaagagggcctatttcccatgattccttcatatttgca
gtctctccctcaccggttgaggtagtgatccccaaggagtctagacttaagccatggttccagcccgtccttctcccggataaagggtactaaggaagtataaacgt
```
──── LeftITR ────▶        ──────── U6 ────────
```
     120         140         160         180         200
```

```
tatacgatacaaggctgttagagagataattagaattaatttgactgtaaacacaaagatattagtacaaaatacgtgacgtagaaagtaataatttcttgggtagt
atatgctatgttccgacaatctctctattaatcttaattaaactgacatttgtgtttctataatcatgtttatgcactgcatctttcattattaaagaacccatca
```
──────────── U6 ────────────
```
     220         240         260         280         300         320
```

```
ttgcagttttaaaattatgttttaaaatggactatcatatgcttaccgtaacttgaaagtatttcgatttcttggctttatatatcttgtggaaaggacgaaacacc
aacgtcaaaatttaatacaaaattttacctgatagtatacgaatggcattgaacttcataaagctaaagaaccgaaatatatagaacacctttcctgctttgtgg
```
──────────── U6 ────────────▶
```
     340         360         380         400         420
```

```
(N)16-26       gttttagtactctggaaacagaatctactaaaacaaggcaaaatgccgtgtttatctcgtcaacttgttggcgagattttttcgact
(N)16-26       caaaatcatgagacctttgtcttagatgattttgttccgttttacggcacaaatagagcagttgaacaaccgctctaaaaagctga
```
─gRNA1 (N)16-26─▶  ────────── TRACR ──────────▶
```
     440         460         480         500         520
```

```
tagttcgatcgaaggaaggtcgggcaggaagagggcctatttcccatgattccttcatatttgcatatacgatacaaggctgttagagagataattagaattaattt
atcaagctagcttccttccagcccgtccttctcccggataaagggtactaaggaagtatatgctatgttccgacaatctctctattaatcttaattaaa
```
──────────── U6 ────────────
```
     540         560         580         600         620         640
```

```
gactgtaaacacaaagatattagtacaaaatacgtgacgtagaaagtaataatttcttgggtagtttgcagttttaaaattatgttttaaaatggactatcatatgc
ctgacatttgtgtttctataatcatgtttatgcactgcatctttcattattaaagaacccatcaaacgtcaaaatttaatacaaaattttacctgatagtatacg
```
──────────── U6 ────────────
```
     660         680         700         720         740
```

```
ttaccgtaacttgaaagtatttcgatttcttggctttatatatcttgtggaaaggacgaaacacc  (N)16-26       gttttagtactctggaaacaga
aatggcattgaactttcataaagctaaagaaccgaaatatatagaacacctttcctgctttgtgg  (N)16-26       caaaatcatgagacctttgtct
```
──────── U6 ────────▶  ─gRNA2 (N)16-26─▶ ─ TRACR ─
```
     760         780         800         820         840
```

FIG. 19A

FIG. 19B gattattgactatgaaacaagggacgtgatcgacgcaggcgtcagactgttcaaggaggccaacgtggaaaacaatgagggacggagaagcaagaggggagccaggc
ctaataactgatactttgttccctgcactagctgcgtccgcagtctgacaagttcctccggttgcaccttttgttactccctgcctcttcgttctcccctcggtccg gcctgaaacgacggagaaggcacagaatccagagggtgaagaaactgctgttcgattacaacctgctgaccgaccattctgagctgagtggaattaatccttatgaa
cggactttgctgcctcttccgtgtcttaggtctcccacttcttgacgacaagctaatgttggacgactggctggtaagactcgactcaccttaattaggaatactt gccagggtgaaaggcctgagtcagaagctgtcagaggaagagtttccgcagctctgctgcacctggctaagcgccgaggagtgcataacgtcaatgaggtggaaga
cggtcccactttccggactcagtcttcgacagtctccttctcaaaaggcgtcgagacgacgtggaccgattcgcggctcctcacgtattgcagttactccaccttct ggacaccggcaacgagctgtctacaaaggaacagatctcacgcaatagcaaagctctggaagagaagtatgtcgcagagctgcagctggaacggctgaagaaagatg
cctgtggccgttgctcgacagatgtttccttgtctagagtgcgttatcgtttcgagaccttctcttcatacagcgtctcgacgtcgaccttgccgacttcttctac gcgaggtgagagggtcaattaataggttcaagacaagcgactacgtcaaagaagccaagcagctgctgaaagtgcagaaggcttaccaccagctggatcagagcttc
cgctccactctcccagttaattatccaagttctgttcgctgatgcagttcttcggttcgtcgacgactttcacgtcttccgaatggtggtcgacctagtctcgaag atcgatacttatatcgacctgctggagactcggagaacctactatgagggaccaggagaagggagcccttcggatggaaagacatcaaggaatggtacgagatgct
tagctatgaatatagctggacgacctctgagcctcttggatgatactccctggtcctcttccctcggggaagcctacctttctgtagttccttaccatgctctacga gatgggacattgcacctatttccagaagagctgagaagcgtcaagtacgcttataacgcagatctgtacaacgccctgaatgacctgaacaacctggtcatcacca
ctaccctgtaacgtggataaaaggtcttctcgactcttcgcagttcatgcgaatattgcgtctagacatgttgcgggacttactggacttgttggaccagtagtggt gggatgaaaacgagaaactggaatactatgagaagttccagatcatcgaaacgtgtttaagcagaagaaaaagcctacactgaaacagattgctaaggagatcctg
ccctactttgctctttgacctatgatactcttcaaggtctagtagcttttgcacaaattcgtcttcttttcggatgtgactttgtctaacgattcctctaggac

FIG. 19C

```
gtcaacgaagaggacatcaagggctaccgggtgacaagcactggaaaaccagagttcaccaatctgaaagtgtatcacgatattaaggacatcacagcacggaaaga
cagttgcttctcctgtagttcccgatggcccactgttcgtgaccttttggtctcaagtggttagactttcacatagtgctataattcctgtagtgtcgtgcctttct
```

SA Cas9

2,580    2,600    2,620    2,640    2,660

```
aatcattgagaacgccgaactgctggatcagattgctaagatcctgactatctaccagagctccgaggacatccaggaagagctgactaacctgaacagcgagctga
ttagtaactcttgcggcttgacgaccgtagtctaacgattctaggactgatagatggtctcgaggctcctgtaggtccttctcgactgattggacttgtcgctcgact
```

SA Cas9

2,680    2,700    2,720    2,740    2,760    2,780

```
cccaggaagagatcgaacagattagtaatctgaaggggtacaccggaacacacaacctgtccctgaaagctatcaatctgattctggatgagctgtggcatacaaac
gggtccttctctagcttgtctaatcattagacttcccatgtggccttgtgtgttggacagggactttcgatagttagactaagacctactcgacaccgtatgtttg
```

SA Cas9

2,800    2,820    2,840    2,860    2,880

```
gacaatcagattgcaatctttaaccggctgaagctggtcccaaaaaaggtggacctgagtcagcagaaagagatcccaaccacactggtggacgatttcattctgtc
ctgttagtctaacgttagaaattggccgacttcgaccagggttttttccacctggactcagtcgtcttctctagggttggtgtgaccacctgctaaagtaagacag
```

SA Cas9

2,900    2,920    2,940    2,960    2,980

```
acccgtggtcaagcggagcttcatccagagcatcaaagtgatcaacgccatcatcaagaagtacggcctgcccaatgatatcattatcgagctggctagggagaaga
tgggcaccagttcgcctcgaagtaggtctcgtagtttcactagttgcggtagtagttcttcatgccggacgggttactatagtaatagctcgaccgatccctcttct
```

SA Cas9

3,000    3,020    3,040    3,060    3,080    3,100

```
acagcaaggacgcacagaagatgatcaatgagatgcagaaaacgaaaccggcagaccaatgaacgcattgaagagattatccgaactaccggaaaagagaacgcaaag
tgtcgttcctgcgtgtcttctactagttactctacgtctttgctttggccgtctggttacttgcgtaacttctctaataggcttgatggccctttctcttgcgtttc
```

SA Cas9

3,120    3,140    3,160    3,180    3,200

```
tacctgattgaaaaaatcaagctgcacgatatgcaggagggaaagtgtctgtattctctggaggccatcccctggaggacctgctgaacaatccattcaactacga
atggactaacttttttagttcgacgtgctatacgtcctcccttttcacagacataagagacctccggtaggggggacctcctggacgacttgttaggtaagttgatgct
```

SA Cas9

3,220    3,240    3,260    3,280    3,300

```
ggtcgatcatattatccccagaagcgtgtccttcgacaattcctttaacaacaaggtgctggtcaagcaggaagagaactctaaaaagggcaataggactcctttcc
ccagctagtataataggggtcttcgcacaggaagctgttaaggaaattgttgttccacgaccagttcgtccttctcttgagattttttcccgttatcctgaggaaagg
```

SA Cas9

```
agtacctgtctagttcagattccaagatctcttacgaaacctttaaaaagcacattctgaatctggccaaaggaaagggccgcatcagcaagaccaaaaaggagtac
tcatggacagatcaagtctaaggttctagagaatgctttggaaattttcgtgtaagacttagaccggtttcctttcccggcgtagtcgttctggttttcctcatg
                                                    SA Cas9
         3,440         3,460         3,480         3,500         3,520 ctgctggaagagcgggacatcaacagattctccgtccagaaggattttattaaccggaatctggtggacacaagatacgctactcgcggcctgatgaatctgctgcg
gacgaccttctcgccctgtagttgtctaagaggcaggtcttcctaaaataattggccttagaccacctgtgttctatgcgatgagcgccggactacttagacgacgc
                                                    SA Cas9
         3,540         3,560         3,580         3,600         3,620 atcctatttccgggtgaacaatctggatgtgaaagtcaagtccatcaacggcggttcacatcttttctgaggcgcaaatggaagtttaaaaaggagcgcaacaaag
taggataaaggcccacttgttagacctacactttcagttcaggtagttgccgcccaagtgtagaaaagactccgcgtttaccttcaaattttcctcgcgttgtttc
                                                    SA Cas9
3,640         3,660         3,680         3,700         3,720         3,740 ggtacaagcaccatgccgaagatgctctgattatcgcaaatgccgacttcatctttaaggagtggaaaaagctggacaaagccaagaaagtgatggagaaccagatg
ccatgttcgtggtacggcttctacgagactaatagcgtttacggctgaagtagaaattcctcacctttttcgacctgtttcggttctttcactacctcttggtctac
                                                    SA Cas9
         3,760         3,780         3,800         3,820         3,840 ttcgaagagaagcaggccgaatctatgcccgaaatcgagacagaacaggagtacaaggagattttcatcactcctcaccagatcaagcatatcaaggatttcaagga
aagcttctcttcgtccggcttagatacgggctttagctctgtcttgtcctcatgttcctctaaaagtagtgaggagtggtctagttcgtatagttcctaaagttcct
                                                    SA Cas9
         3,860         3,880         3,900         3,920         3,940 ctacaagtactctcaccgggtggataaaaagcccaacagagagctgatcaatgacaccctgtatagtacaagaaaagacgataaggggaataccctgattgtgaaca
gatgttcatgagagtggcccacctattttcgggttgtctctcgactagttactgtgggacatatcatgttcttttctgctattcccttatgggactaacacttgt
                                                    SA Cas9
3,960         3,980         4,000         4,020         4,040         4,060 atctgaacggactgtacgacaaagataatgacaagctgaaaaagctgatcaacaaaagtcccgagaagctgctgatgtaccaccatgatcctcagacatatcagaaa
tagacttgcctgacatgctgtttctattactgttcgacttttcgactagttgttttcagggctcttcgacgactacatggtggtactaggagtctgtatagtcttt
                                                    SA Cas9
         4,080         4,100         4,120         4,140         4,160 ctgaagctgattatggagcagtacggcgacgagaagaacccactgtataagtactatgaagagactgggaactacctgaccaagtatagcaaaaaggataatggccc
gacttcgactaatacctcgtcatgccgctgctcttcttgggtgacatattcatgatacttctctgacccttgatggactggttcatatcgttttcctattaccggg
                                                    SA Cas9
         4,180         4,200         4,220         4,240         4,260         4,280
```

FIG. 19E

```
cgtgatcaagaagatcaagtactatgggaacaagctgaatgcccatctggacatcacagacgattaccctaacagtcgcaacaaggtggtcaagctgtcactgaagc
gcactagttcttctagttcatgataccgttgttcgacttacgggtagacctgtagtgtctgctaatgggattgtcagcgttgttccaccagttcgacagtgacttcg
                                              SA Cas9
        4,300        4,320        4,340        4,360        4,380 catacagattcgatgtctatctggacaacggcgtgtataaatttgtgactgtcaagaatctggatgtcatcaaaaaggagaactactatgaagtgaatagcaagtgc
gtatgtctaagctacagatagacctgttgccgcacatatttaaacactgacagttcttagacctacagtagttttttcctcttgatgatacttcacttatcgttcacg
                                              SA Cas9
        4,400        4,420        4,440        4,460        4,480 tacgaagaggctaaaaagctgaaaaagattagcaaccaggcagagttcatcgcctccttttacaacaacgacctgattaagatcaatggcgaactgtatagggtcat
atgcttctccgattttttcgacttttttctaatcgttggtccgtctcaagtagcggaggaaaatgttgttgctggactaattctagttaccgcttgacatatcccagta
                                              SA Cas9
        4,500        4,520        4,540        4,560        4,580        4,600 cggggtgaacaatgatctgctgaaccgcattgaagtgaatatgattgacatcacttaccgagagtatctggaaaacatgaatgataagcgcccccctcgaattatca
gccccacttgttactagacgacttggcgtaacttcacttatactaactgtagtgaatggctctcatagacccttttgtacttactattcgcggggggagcttaatagt
                                              SA Cas9
        4,620        4,640        4,660        4,680        4,700 aaacaattgcctctaagactcagagtatcaaaaagtactcaaccgacattctgggaaacctgtatgaggtgaagagcaaaaagcaccctcagattatcaaaagggc
tttgttaacggagattctgagtctcatagttttttcatgagttggctgtaagacccttggacatactccacttctcgttttttcgtgggagtctaatagttttttcccg
                                              SA Cas9
        4,720        4,740        4,760        4,780        4,800 ggatcccccaagaagaagaggaaagtctcgagcgactacaaagaccatgacggtgattataaagatcatgacatcgattacaaggatgacgatgacaagtagcaata
cctagggggttcttcttctcctttcagagctcgctgatgtttctggtactgccactaatatttctagtactgtagctaatgttcctactgctactgttcatcgttat
            NLS                                          3xFLAG
        4,820        4,840        4,860        4,880        4,900        4,920 aaggatcgtttattttcattggaagcgtgtgttggtttttgatcaggcgcgtccaagcttcgcaggaaagaacatgtgagcaaaaggccagcaaaaggcgttaact
ttcctagcaaataaaagtaaccttcgcacacaaccaaaaaactagtccgcgcaggttcgaagcgtcctttcttgtacactcgttttccggtcgttttccgcaattga
                 miniPA
        4,940        4,960        4,980        5,000        5,020 ctagatttaaatgcatgctggggagagatctaggaaccccctagtgatggagttggccactccctctctgcgcgctcgctcgctcactgaggccgcccgggcaaagcc
gatctaaatttacgtacgaccccctctctagatccttggggatcactacctcaaccggtgagggagagacgcgcgagcgagcgagtgactccggcgggcccgtttcgg
                                              Right ITR
        5,040        5,060        5,080        5,100        5,120
```

FIG. 19F cgggcgtcgggcgacctttggtcgcccggcctcagtgagcgagcgagcgcgcagagagggagtggccaa
gcccgcagcccgctggaaaccagcgggccggagtcactcgctcgctcgcgcgtctctccctcaccggtt Right ITR 5,140    5,150    5,160    5,170    5,180    5,190    5,200

FIG. 19G ttggccactccctctctgcgcgctcgctcgctcactgaggccgggcgaccaaaggtcgcccgacgcccgggctttgcccgggcggcctcagtgagcgagcgagcgcg
aaccggtgagggagagacgcgcgagcgagcgagtgactccggcccgctggtttccagcgggctgcgggcccgaaacgggcccgccggagtcactcgctcgctcgcgc Left LTR

|————|————|————|————|————|
20   40   60   80   100 cagagagggagtggccaactccatcactaggggttcctcagatctgaattcggtaccaaggtcgggcaggaagagggcctatttcccatgattccttcatatttgca
gtctctccctcaccggttgaggtagtgatcccaaggagtctagacttaagccatggttccagcccgtccttctcccggataaagggtactaaggaagtataaacgt Left LTR                                              U6

|————|————|————|————|————|
120  140  160  180  200 tatacgatacaaggctgttagagagataattagaattaatttgactgtaaacacaaagatattagtacaaaatacgtgacgtagaaagtaataatttcttgggtagt
atatgctatgttccgacaatctctctattaatcttaattaaactgactttgtgtttctataatcatgttttatgcactgcatctttcattattaaagaacccatca

U6

|————|————|————|————|————|
220  240  260  280  300  320 ttgcagttttaaaattatgttttaaaatggactatcatatgcttaccgtaacttgaaagtatttcgatttcttggctttatatatcttgtggaaaggacgaaacacc
aacgtcaaaattttaatacaaaattttacctgatagtatacgaatggcattgaactttcataaagctaaagaaccgaaatatatagaacacctttcctgctttgtgg

U6

|————|————|————|————|————|
340  360  380  400  420

(N)₁₆₋₂₆              gttttagtactctggaaacagaatctactaaaacaaggcaaaatgccgtgtttatctcgtcaacttgttggcgagatttttcgact
(N)₁₆₋₂₆              caaaatcatgagacctttgtcttagatgattttgttccgttttacggcacaaatagagcagttgaacaaccgctctaaaaaagctga gRNA1 (N)16-26                              TRACR

|————|————|————|————|————|
440  460  480  500  520 tagttcgatcgaaggaaggtcgggcaggaagagggcctatttcccatgattccttcatatttgcatatacgatacaaggctgttagagagataattagaattaatt
atcaagctagcttccttccagcccgtccttctcccggataaagggtactaaggaagtataaacgtatatgctatgttccgacaatctctctattaatcttaattaaa

U6

|————|————|————|————|————|
540  560  580  600  620  640 gactgtaaacacaaagatattagtacaaaatacgtgacgtagaaagtaataatttcttgggtagtttgcagttttaaaattatgttttaaaatggactatcatatgc
ctgacatttgtgtttctataatcatgttttatgcactgcatctttcattattaaagaacccatcaaacgtcaaaattttaatacaaaattttacctgatagtatacg

U6

|————|————|————|————|————|
650  680  700  720  740 ttaccgtaacttgaaagtatttcgatttcttggctttatatatcttgtggaaaggacgaaacacc (N)₁₆₋₂₆         gttttagtactctggaaacaga
aatggcattgaactttcataaagctaaagaaccgaaatatatagaacacctttcctgctttgtgg (N)₁₆₋₂₆         caaaatcatgagacctttgtct U6                                      gRNA2 (N)16-26   TRACR

|————|————|————|————|————|
760  780  800  820  840

FIG. 20A

FIG. 20B aggaacagatctcacgcaatagcaaagctctggaagagaagtatgtcgcagagctgcagctggaacggctgaagaaagatggcgaggtgagagggtcaattaatagg
tccttgtctagagtgcgttatcgtttcgagaccttctcttcatacagcgtctcgacgtcgaccttgccgacttctttctaccgctccactctcccagttaattatcc 1,720    1,740    1,760    1,780    1,800 ttcaagacaagcgactacgtcaaagaagccaagcagctgctgaaagtgcagaaggcttaccaccagctggatcagagcttcatcgatacttatatcgacctgctgga
aagttctgttcgctgatgcagtttcttcggttcgtcgacgactttcacgtcttccgaatggtggtcgacctagtctcgaagtagctatgaatatagctggacgacct 1,820    1,840    1,860    1,880    1,900    1,920 gactcggagaacctactatgagggaccaggagaagggagccccttcggatggaaagacatcaaggaatggtacgagatgctgatgggacattgcacctatttccag
ctgagcctcttggatgatactccctggtcctcttccctcggggaagcctacctttctgtagttccttaccatgctctacgactaccctgtaacgtggataaaaggtc 1,940    1,960    1,980    2,000    2,020 aagagctgagaagcgtcaagtacgcttataacgcagatctgtacaacgccctgaatgacctgaacaacctggtcatcaccagggatgaaaacgagaaactggaatac
ttctcgactcttcgcagttcatgcgaatattgcgtctagacatgttgcgggacttactggacttgttggaccagtagtggtccctacttttgctctttgaccttatg 2,040    2,060    2,080    2,100    2,120    2,140 tatgagaagttccagatcatcgaaaacgtgtttaagcagaagaaaaagcctacactgaaacagattgctaaggagatcctggtcaacgaagaggacatcaagggcta
atactcttcaaggtctagtagcttttgcacaaattcgtcttcttttttcggatgtgactttgtctaacgattcctctaggaccagttgcttctcctgtagttcccgat 2,160    2,180    2,200    2,220    2,240 ccgggtgacaagcactggaaaaccagagttcaccaatctgaaagtgtatcacgatattaaggacatcacagcacggaaagaaatcattgagaacgccgaactgctgg
ggcccactgttcgtgaccttttggtctcaagtggttagactttcacatagtgctataattcctgtagtgtcgtgcctttctttagtaactcttgcggcttgacgacc 2,260    2,280    2,300    2,320    2,340 atcagattgctaagatcctgactatctaccagagctccgaggacatccaggaagagctgactaacctgaacagcgagctgacccaggaagagatcgaacagattagt
tagtctaacgattctaggactgatagatggtctcgaggctcctgtaggtccttctcgactgattggacttgtcgctcgactgggtccttctctagcttgtctaatca 2,360    2,380    2,400    2,420    2,440    2,460 aatctgaaggggtacaccggaacacacaacctgtccctgaaagctatcaatctgattctggatgagctgtggcatacaaacgacaatcagattgcaatctttaaccg
ttagacttcccatgtggccttgtgtgttggacagggactttcgatagttagactaagacctactcgacaccgtatgtttgctgttagtctaacgttagaaattggc 2,480    2,500    2,520    2,540    2,560

FIG. 20C

```
gctgaagctggtcccaaaaaaggtggacctgagtcagcagaaagagatcccaaccacactggtggacgatttcattctgtcacccgtggtcaagcggagcttcatcc
cgacttcgaccagggttttttccacctggactcagtcgtctttctctagggttggtgtgaccacctgctaaagtaagacagtgggcaccagttcgcctcgaagtagg
```

```
agagcatcaaagtgatcaacgccatcatcaagaagtacggcctgcccaatgatatcattatcgagctggctagggagaagaacagcaaggacgcacagaagatgatc
tctcgtagtttcactagttgcggtagtagttcttcatgccggacgggttactatagtaatagctcgaccgatccctcttcttgtcgttcctgcgtgtcttctactag
```

```
aatgagatgcagaaacgaaaccggcagaccaatgaacgcattgaagagattatccgaactaccgggaaagagaacgcaaagtacctgattgaaaaaatcaagctgca
ttactctacgtctttgctttggccgtctggttacttgcgtaacttctctaataggcttgatggcccttctcttgcgtttcatggactaacttttttagttcgacgt
```

```
cgatatgcaggagggaaagtgtctgtattctctggaggccatcccctggaggacctgctgaacaatccattcaactacgaggtcgatcatattatcccagaagcg
gctatacgtcctcccttcacagacataagagacctccggtaggggggacctcctggacgacttgttaggtaagttgatgctccagctagtataataggggtcttcgc
```

```
tgtccttcgacaattccttaacaacaaggtgctggtcaagcaggaagagaactctaaaaagggcaataggactcctttccagtacctgtctagttcagattccaag
acaggaagctgttaaggaaattgttgttccacgaccagttcgtccttctcttgagattttccccgttatcctgaggaaaggtcatggacagatcaagtctaaggttc
```

```
atctcttacgaaacctttaaaaagcacattctgaatctggccaaaggaaagggccgcatcagcaagaccaaaaaggagtacctgctggaagagcgggacatcaacag
tagagaatgctttggaaattttcgtgtaagacttagaccggtttccttcccgcgtagtcgttctggttttcctcatggacgaccttctcgccctgtagttgtc
```

```
attctccgtccagaaggattttattaaccggaatctggtggacacaagatacgctactcgcgcctgatgaatctgctgcgatcctatttccgggtgaacaatctgg
taagaggcaggtcttcctaaaataattggccttagaccacctgtgttctatgcgatgagcgccggactacttagacgacgctaggataaaggcccacttgttagacc
```

```
atgtgaaagtcaagtccatcaacggcgggttcacatcttttctgaggcgcaaatggaagtttaaaaaggagcgcaacaaagggtacaagcaccatgccgaagatgct
tacactttcagttcaggtagttgccgcccaagtgtagaaaagactccgcgtttaccttcaaattttcctcgcgttgtttcccatgttcgtggtacggcttctacga
```

FIG. 20D

```
ctgattatcgcaaatgccgacttcatctttaaggagtggaaaaagctggacaaagccaagaaagtgatggagaaccagatgttcgaagagaagcaggccgaatctat
gactaatagcgtttacggctgaagtagaaattcctcaccttttcgacctgtttcggttctttcactacctcttggtctacaagcttctcttcgtccggcttagata
                                                SA Cas9
         3,440            3,460            3,480            3,500            3,520 gcccgaaatcgagacagaacaggagtacaaggagatttcatcactcctcaccagatcaagcatatcaaggatttcaaggactacaagtactctcaccgggtggata
cgggctttagctctgtcttgtcctcatgttcctctaaaagtagtgaggagtggtctagttcgtatagttcctaaagttcctgatgttcatgagagtggcccacctat
                                                SA Cas9
         3,540            3,560            3,580            3,600            3,620 aaaagcccaacagagagctgatcaatgacaccctgtatagtacaagaaaagacgataaggggaatacccctgattgtgaacaatctgaacggactgtacgacaaagat
ttttcgggttgtctctcgactagttactgtgggacatatcatgttcttttctgctattccccttatgggactaacacttgttagacttgcctgacatgctgtttcta
                                                SA Cas9
  3,640           3,660            3,680            3,700            3,720            3,740 aatgacaagctgaaaaagctgatcaacaaaagtcccgagaagctgctgatgtaccaccatgatcctcagacatatcagaaactgaagctgattatggagcagtacgg
ttactgttcgacttttcgactagttgttttcaggctcttcgacgactacatggtggtactaggagtctgtatagtctttgacttcgactaatacctcgtcatgcc
                                                SA Cas9
         3,760            3,780            3,800            3,820            3,840 cgacgagaagaacccactgtataagtactatgaagagactgggaactacctgaccaagtatagcaaaaaggataatggccccgtgatcaagaagatcaagtactatg
gctgctcttcttgggtgacatattcatgatacttctctgaccccttgatggactggttcatatcgttttcctattaccggggcactagttcttctagttcatgatac
                                                SA Cas9
         3,860            3,880            3,900            3,920            3,940 ggaacaagctgaatgcccatctggacatcacagacgattaccctaacagtcgcaacaaggtggtcaagctgtcactgaagccatacagattcgatgtctatctggac
ccttgttcgacttacgggtagacctgtagtgtctgctaatgggattgtcagcgttgttccaccagttcgacagtgacttcggtatgtctaagctacagatagacctg
                                                SA Cas9
 3,960           3,980            4,000            4,020            4,040            4,060 aacggcgtgtataaatttgtgactgtcaagaatctggatgtcatcaaaaaggagaactactatgaagtgaatagcaagtgctacgaagaggctaaaaagctgaaaaa
ttgccgcacatatttaaacactgacagttcttagacctacagtagttttcctcttgatgatacttcacttatcgttcacgatgcttctccgatttttcgactttt
                                                SA Cas9
         4,080            4,100            4,120            4,140            4,160 gattagcaaccaggcagagttcatcgcctccttttacaacaacgacctgattaagatcaatggcgaactgtataggggtcatcggggtgaacaatgatctgctgaacc
ctaatcgttggtccgtctcaagtagcggaggaaaatgttgttgctggactaattctagttaccgcttgacatatcccagtagcccacttgttactagacgacttgg
                                                SA Cas9
         4,180            4,200            4,220            4,240            4,260            4,280
```

FIG. 20E

```
gcattgaagtgaatatgattgacatcacttaccgagagtatctggaaaacatgaatgataagcgcccccctcgaattatcaaaacaattgcctctaagactcagagt
cgtaacttcacttatactaactgtagtgaatggctctcatagaccttttgtacttactattcgcggggggagcttaatagttttgttaacggagattctgagtctca
```
SA Cas9
4,300    4,320    4,340    4,360    4,380

```
atcaaaaagtactcaaccgacattctgggaaacctgtatgaggtgaagagcaaaaagcaccctcagattatcaaaaagggcggatcccccaagaagaagaggaaagt
tagttttcatgagttggctgtaagacccttggacatactccacttctcgttttcgtgggagtctaatagttttcccgcctagggggttcttcttctcctttca
```
SA Cas9    NLS
4,400    4,420    4,440    4,460    4,480

```
ctcgagcgactacaaagaccatgacggtgattataaagatcatgacatcgattacaaggatgacgatgacaagtagcaataaaggatcgtttattttcattggaagc
gagctcgctgatgtttctggtactgccactaatatttctagtactgtagctaatgttcctactgctactgttcatcgttatttcctagcaaataaaagtaaccttcg
```
3XFLAG    BGH pA
4,500    4,520    4,540    4,560    4,580    4,600

```
gtgtgttggttttttgatcaggcgcgtccaagcttcgcaggaaagaacatgtgagcaaaaggccagcaaaaggcgttaactctagatttaaatgcatgctggggaga
cacacaaccaaaaaactagtccgcgcaggttcgaagcgtccttcttgtacactcgttttccggtcgtttccgcaattgagatctaaatttacgtacgacccctct
```
BGH pA
4,620    4,640    4,660    4,680    4,700

```
gatctaggaacccctagtgatggagttggccactccctctctgcgcgctcgctcgctcactgaggccgcccgggcaaagcccggcgtcgggcgacctttggtcgcc
ctagatccttggggatcactacctcaaccggtgagggagagacgcgcgagcgagcgagtgactccggcgggcccgtttcgggcccgcagcccgctggaaaccagcgg
```
Right ITR
4,720    4,740    4,760    4,780    4,800

```
cggcctcagtgagcgagcgagcgcgcagagagggagtggccaa
gccggagtcactcgctcgctcgcgcgtctctccctcaccggtt
```
Right ITR
4,820    4,830    4,840    4,850

FIG. 20F ttggccactccctctctgcgcgctcgctcgctcactgaggccgggcgaccaaaggtcgcccgacgcccgggctttgcccggcggcctcagtgagcgagcgagcgcg
aaccggtgagggagagacgcgcgagcgagcgagtgactccggcccgctggtttccagcgggctgcgggcccgaaacgggcccgccggagtcactcgctcgctcgcgc Left ITR cagagagggagtggccaactccatcactaggggttcctcgagatctgaattcggtaccaaggtcgggcaggaagagggcctatttcccatgattccttcatatttgca
gtctctccctcaccggttgaggtagtgatccccaaggagtctagacttaagccatggttccagcccgtccttctcccggataaagggtactaaggaagtataaacgt Left ITR                    U6 tatacgatacaaggctgttagagagataattagaattaatttgactgtaaacacaaagatattagtacaaaatacgtgacgtagaaagtaataatttcttgggtagt
atatgctatgttccgacaatctctctattaatcttaattaaactgacatttgtgtttctataatcatgttttatgcactgcatctttcattattaaagaacccatca

U6 ttgcagttttaaaattatgtttaaaatggactatcatatgcttaccgtaacttgaaagtatttcgatttcttggctttatatatcttgtggaaaggacgaaacacc
aacgtcaaaattttaatacaaaattttacctgatagtatacgaatggcattgaactttcataaagctaaagaaccgaaatatatgaacacctttcctgctttgtgg

U6

(N)16-26          gttttagtactctggaaacagaatctactaaaacaaggcaaaatgccgtgtttatctcgtcaacttgttggcgagattttttcgact
(N)16-26          caaaatcatgagacctttgtcttagatgattttgttccgttttacggcacaaatagagcagttgaacaaccgctctaaaaaagctga gRNA1 (N)16-26                    TRACR tagttcgatcgaaggaaggtcgggcaggaagagggcctatttcccatgattccttcatatttgcatatacgatacaaggctgttagagagataattagaattaattt
atcaagctagcttccttccagcccgtccttctcccggataaagggtactaaggaagtataaacgtatatgctatgttccgacaatctctctattaatcttaattaaa

U6 gactgtaaacacaaagatattagtacaaaatacgtgacgtagaaagtaataatttcttgggtagtttgcagttttaaaattatgtttaaaatggactatcatatgc
ctgacatttgtgtttctataatcatgttttatgcactgcatctttcattattaaagaacccatcaaacgtcaaaattttaatacaaaattttacctgatagtatacg

U6 ttaccgtaacttgaaagtatttcgatttcttggctttatatatcttgtggaaaggacgaaacacc      (N)16-26       gttttagtactctggaaacaga
aatggcattgaactttcataaagctaaagaaccgaaatatatgaacacctttcctgctttgtgg       (N)16-26       caaaatcatgagacctttgtct U6                                                       gRNA1 (N)16-26           TRACR

FIG. 21A atctactaaaacaaggcaaaatgccgtgtgtttatctcgtcaacttgttggcgagattttttggtaccgctagcgcttaagtcgcgatgtacgggccagatatacgcgt
tagatgattttgttccgttttacggcacaaatagagcagttgaacaaccgctctaaaaaaccatggcgatcgcgaattcagcgctacatgcccggtctatatgcgca 860　　　　880　　　　900　　　　920　　　　940　　　　960 tgacattgattattgactagtGGGCCCCAGAAGCCTGGTGGTTGTTTGTCCTTCTCAGGGGAAAAGTGAGGCGGCCCCTTGGAGGAAGGGGCCGGGCAGAATGATCT
actgtaactaataactgatcaCCCGGGGTCTTCGGACCACCAACAAACAGGAAGAGTCCCCTTTTCACTCCGCCGGGGAACCTCCTTCCCCGGCCCGTCTTACTAGA 980　　　　1,000　　　1,020　　　1,040　　　1,060

AATCGGATTCCAAGCAGCTCAGGGGATTGTCTTTTTCTAGCACCTTCTTGCCACTCCTAAGCGTCCTCCGTGACCCCGGCTGGGATTTCGCCTGGTGCTGTGTCAGC
TTAGCCTAAGGTTCGTCGAGTCCCCTAACAGAAAAAGATCGTGGAAGAACGGTGAGGATTCGCAGGAGGCACTGGGGCCGACCCTAAAGCGGACCACGACACAGTCG 1,080　　　1,100　　　1,120　　　1,140　　　1,160

CCCGGTCTCCCAGGGGCTTCCCAGTGGTCCCCAGGAACCCTCGACAGGGCCCGGTCTCTCTCGTCCAGCAAGGGCAGGGACGGGCCACAGGCCAAGGGCgcggccgc
GGGCCAGAGGGTCCCCGAAGGGTCACCAGGGGTCCTTGGGAGCTGTCCCGGGCCAGAGAGAGCAGGTCGTTCCCGTCCCTGCCCGGTGTCCGGTTCCCGcgccggcg 1,180　　　1,200　　　1,220　　　1,240　　　1,260　　　1,280 taatacgactcactatagggagagccgccaccatgccgaagaaaaagcgcaaggtcgaagcgtccatgaaaaggaactacattctggggctggacatcgggattaca
attatgctgagtgatatccctctcggcggtggtacggcttcttttttcgcgttccagcttcgcaggtacttttccttgatgtaagaccccgacctgtagccctaatgt 1,300　　　1,320　　　1,340　　　1,360　　　1,380 agcgtggggtatgggattattgactatgaaacaagggacgtgatcgacgcaggcgtcagactgttcaaggaggccaacgtggaaaacaatgagggacggagaagcaa
tcgcacccataccctaataactgatactttgttccctgcactagctgcgtccgcagtctgacaagttcctccggttgcaccttttgttactccctgcctcttcgtt 1,400　　　1,420　　　1,440　　　1,460　　　1,480 gaggggagccaggcgcctgaaacgacggagaaggcacagaatccagagggtgaagaaactgctgttcgattacaacctgctgaccgaccattctgagctgagtggaa
ctccctcggtccgcggactttgctgcctcttccgtgtcttaggtctcccacttcttgacgacaagctaatgttggacgactggctggtaagactcgactcaccctt 1,500　　　1,520　　　1,540　　　1,560　　　1,580　　　1,600 ttaatccttatgaagccagggtgaaaggcctgagtcagaagctgtcagaggaagagttttccgcagctctgctgcacctggctaagcgccgaggagtgcataacgtc
aattaggaatacttcggtcccactttccggactcagtcttcgacagtctccttctcaaaaggcgtcgagacgacgtggaccgattcgcggctcctcacgtattgcag 1,620　　　1,640　　　1,660　　　1,680　　　1,700

FIG. 21B

```
aatgaggtggaagaggacaccggcaacgagctgtctacaaaggaacagatctcacgcaatagcaaagctctggaagagaagtatgtcgcagagctgcagctggaacg
ttactccaccttctcctgtggccgttgctcgacagatgtttccttgtctagagtgcgttatcgtttcgagaccttctcttcatacagcgtctcgacgtcgaccttgc
```
SA_Cas9
```
    1,720         1,740         1,760         1,780         1,800
```

```
gctgaagaaagatggcgaggtgagagggtcaattaataggttcaagacaagcgactacgtcaaagaagccaagcagctgctgaaagtgcagaaggcttaccaccagc
cgacttctttctaccgctccactctcccagttaattatccaagttctgttcgctgatgcagtttcttcggttcgtcgacgactttcacgtcttccgaatggtggtcg
```
SA_Cas9
```
1,820         1,840         1,860         1,880         1,900         1,920
```

```
tggatcagagcttcatcgatacttatatcgacctgctggagactcggagaacctactatgagggaccaggagaagggagcccttcggatggaaagacatcaaggaa
acctagtctcgaagtagctatgaatatagctggacgacctctgagcctcttggatgatactccctggtcctcttccctcggggaagcctacctttctgtagttcctt
```
SA_Cas9
```
    1,940         1,960         1,980         2,000         2,020
```

```
tggtacgagatgctgatgggacattgcacctatttttccagaagagctgagaagcgtcaagtacgcttataacgcagatctgtacaacgccctgaatgacctgaacaa
accatgctctacgactaccctgtaacgtggataaaaaggtcttctcgactcttcgcagttcatgcgaatattgcgtctagacatgttgcgggacttactggacttgtt
```
SA_Cas9
```
    2,040         2,060         2,080         2,100         2,120         2,140
```

```
cctggtcatcaccagggatgaaaacgagaaactggaatactatgagaagttccagatcatcgaaaacgtgtttaagcagaagaaaaagcctacactgaaacagattg
ggaccagtagtggtccctactttgctctttgaccttatgatactcttcaaggtctagtagcttttgcacaaattcgtcttcttttttcggatgtgactttgtctaac
```
SA_Cas9
```
    2,160         2,180         2,200         2,220         2,240
```

```
ctaaggagatcctggtcaacgaagaggacatcaagggctaccgggtgacaagcactggaaaaccagagttcaccaatctgaaagtgtatcacgatattaaggacatc
gattcctctaggaccagttgcttctcctgtagttcccgatggcccactgttcgtgacctttggtctcaagtggttagactttcacatagtgctataattcctgtag
```
SA_Cas9
```
    2,260         2,280         2,300         2,320         2,340
```

```
acagcacggaaagaaatcattgagaacgccgaactgctggatcagattgctaagatcctgactatctaccagagctccgaggacatccaggaagagctgactaacct
tgtcgtgcctttctttagtaactcttgcggcttgacgacctagtctaacgattctaggactgatagatggtctcgaggctcctgtaggtccttctcgactgattgga
```
SA_Cas9
```
2,360         2,380         2,400         2,420         2,440         2,460
```

```
gaacagcgagctgacccaggaagagatcgaacagattagtaatctgaaggggtacaccggaacacacaacctgtccctgaaagctatcaatctgattctggatgagc
cttgtcgctcgactgggtccttctctctagcttgtctaatcattagacttccccatgtggccttgtgtgttggacagggactttcgatagttagactaagacctactcg
```
SA_Cas9
```
2,480         2,500         2,520         2,540         2,560
```

FIG. 21C

```
tgtggcatacaaacgacaatcagattgcaatctttaaccggctgaagctggtcccaaaaaaggtggacctgagtcagcagaaagagatcccaaccacactggtggac
acaccgtatgtttgctgttagtctaacgttagaaattggccgacttcgaccagggttttttccacctggactcagtcgtctttctctagggttggtgtgaccacctg
```

SA Cas9
    2,580        2,600        2,620        2,640        2,660

```
gatttcattctgtcacccgtggtcaagcggagcttcatccagagcatcaaagtgatcaacgccatcatcaagaagtacggcctgcccaatgatatcattatcgagct
ctaaagtaagacagtgggcaccagttcgcctcgaagtaggtctcgtagtttcactagttgcggtagtagttcttcatgccggacgggttactatagtaatagctcga
```

SA Cas9
    2,680        2,700        2,720        2,740        2,760        2,780

```
ggctagggagaagaacagcaaggacgcacagaagatgatcaatgagatgcagaaacgaaaccggcagaccaatgaacgcattgaagagattatccgaactaccggga
ccgatccctcttcttgtcgttcctgcgtgtcttctactagttactctacgtctttgctttggccgtctggttacttgcgtaacttctctaataggcttgatggccct
```

SA Cas9
    2,800        2,820        2,840        2,860        2,880

```
aagagaacgcaaagtacctgattgaaaaaatcaagctgcacgatatgcaggagggaaagtgtctgtattctctggaggccatcccctggaggacctgctgaacaat
ttctcttgcgtttcatggactaactttttagttcgacgtgctatacgtcctcccttcacagacataagagacctccggtagggggacctcctggacgacttgtta
```

SA Cas9
    2,900        2,920        2,940        2,960        2,980

```
ccattcaactacgaggtcgatcatattatccccagaagcgtgtccttcgacaattcctttaacaacaaggtgctggtcaagcaggaagagaactctaaaaagggcaa
ggtaagttgatgctccagctagtataataggggtcttcgcacaggaagctgttaaggaaattgttgttccacgaccagttcgtccttctcttgagatttttcccgtt
```

SA Cas9
    3,000        3,020        3,040        3,060        3,080        3,100

```
taggactccttttccagtacctgtctagttcagattccaagatctcttacgaaaacctttaaaaagcacattctgaatctggccaaaggaaagggccgcatcagcaaga
atcctgaggaaaggtcatggacagatcaagtctaaggttctagagaatgctttggaaattttttcgtgtaagacttagaccggtttcctttcccggcgtagtcgttct
```

SA Cas9
    3,120        3,140        3,160        3,180        3,200

```
ccaaaaaggagtacctgctggaagagcgggacatcaacagattctccgtccagaaggattttattaaccggaatctggtggacacaagatacgctactcgcggcctg
ggttttttcctcatggacgaccttctcgccctgtagttgtctaagaggcaggtcttcctaaaataattggccttagaccacctgtgttctatgcgatgagcgccggac
```

SA Cas9
    3,220        3,240        3,260        3,280        3,300

```
atgaatctgctgcgatcctatttccgggtgaacaatctggatgtgaaagtcaagtccatcaacggcggggttcacatcttttctgaggcgcaaatggaagtttaaaaa
tacttagacgacgctaggataaaggcccacttgttagacctacactttcagttcaggtagttgccgcccaagtgtagaaaagactccgcgtttaccttcaaatttt
```

SA Cas9
    3,320        3,340        3,360        3,380        3,400        3,420

FIG. 21D

```
ggagcgcaacaaagggtacaagcaccatgccgaagatgctctgattatcgcaaatgccgacttcatctttaaggagtggaaaaagctggacaaagccaagaaagtga
cctcgcgttgttttcccatgttcgtggtacggcttctacgagactaatagcgtttacggctgaagtagaaattcctcaccttttcgacctgtttcggttctttcact
                                                 SA Cas9
        3,440          3,460          3,480          3,500          3,520 tggagaaccagatgttcgaagagaagcaggccgaatctatgcccgaaatcgagacagaacaggagtacaaggagattttcatcactcctcaccagatcaagcatatc
acctcttggtctacaagcttctcttcgtccggcttagatacgggctttagctctgtcttgtcctcatgttcctctaaaagtagtgaggagtggtctagttcgtatag
                                                 SA Cas9
        3,540          3,560          3,580          3,600          3,620 aaggatttcaaggactacaagtactctcaccgggtggataaaaagcccaacagagagctgatcaatgacaccctgtatagtacaagaaaagacgataaggggaatac
ttcctaaagttcctgatgttcatgagagtggcccacctattttcgggttgtctctcgactagttactgtgggacatatcatgttcttttctgcattccccttatg
                                                 SA Cas9
  3,640          3,660          3,680          3,700          3,720          3,740 cctgattgtgaacaatctgaacggactgtacgacaaagataatgacaagctgaaaaagctgatcaacaaaagtcccgagaagctgctgatgtaccaccatgatcctc
ggactaacacttgttagacttgcctgacatgctgtttctattactgttcgacttttttcgactagttgttttcagggctcttcgacgactacatggtggtactaggag
                                                 SA Cas9
        3,760          3,780          3,800          3,820          3,840 agacatatcagaaactgaagctgattatggagcagtacggcgacgagaagaacccactgtataagtactatgaagagactgggaactacctgaccaagtatagcaaa
tctgtatagtctttgacttcgactaataccctcgtcatgccgctgctcttcttgggtgacatattcatgactttctctgacccttgatggactggttcatatcgttt
                                                 SA Cas9
        3,860          3,880          3,900          3,920          3,940 aaggataatggccccgtgatcaagaagatcaagtactatgggaacaagctgaatgccatctggacatcacagacgattaccctaacagtcgcaacaaggtggtcaa
ttcctattaccggggcactagttcttctagttcatgataccctgttcgacttacgggtagacctgtagtgtctgctaatgggattgtcagcgttgttccaccagtt
                                                 SA Cas9
 3,960          3,980          4,000          4,020          4,040          4,060 gctgtcactgaagccatacagattcgatgtctatctggacaacggcgtgtataaatttgtgactgtcaagaatctggatgtcatcaaaaaggagaactactatgaag
cgacagtgacttcggtatgtctaagctacagatagacctgttgccgcacatatttaaacactgacagttcttagacctacagtagttttcctcttgatgatacttc
                                                 SA Cas9
        4,080          4,100          4,120          4,140          4,160 tgaatagcaagtgctacgaagaggctaaaaagctgaaaaagattagcaaccaggcagagttcatcgcctccttttacaacaacgacctgattaagatcaatggcgaa
acttatcgttcacgatgcttctccgatttttcgacttttctaatcgttggtccgtctcaagtagcggaggaaaatgttgttgctggactaattctagttaccgctt
                                                 SA Cas9
        4,180          4,200          4,220          4,240          4,260          4,280
```

FIG. 21E ttggccactccctctctgcgcgctcgctcgctcactgaggccgggcgaccaaaggtcgcccgacgcccgggctttgcccgggcggcctcagtgagcgagcgagcgcg
aaccggtgagggagagacgcgcgagcgagcgagtgactccggcccgctggttttccagcgggctgcgggcccgaaacgggcccgccggagtcactcgctcgctcgcgc Left ITR cagagagggagtggccaactccatcactaggggttcctcagatctgaattcggtaccaaggtcgggcaggaagagggcctatttcccatgattccttcatatttgca
gtctctccctcaccggttgaggtagtgatccccaaggagtctagacttaagccatggttccagcccgtccttctcccggataaagggtactaaggaagtataaacgt Left ITR                                          U6 tatacgatacaaggctgttagagagataattagaattaatttgactgtaaacacaaagatattagtacaaaatacgtgacgtagaaagtaataatttcttgggtagt
atatgctatgttccgacaatctctctattaatcttaattaaactgacatttgtgtttctataatcatgtttatgcactgcatctttcattattaaagaacccatca

U6 ttgcagttttaaaattatgtttaaaatggactatcatatgcttaccgtaacttgaaagtatttcgatttcttggctttatatatcttgtggaaaggacgaaacacc
aacgtcaaaattttaatacaaaattttacctgatagtatacgaatggcattgaacttcataaagctaaagaaccgaaatatatagaacacctttcctgctttgtgg

U6

(N)₁₆₋₂₆        gttttagtactctggaaacagaatctactaaaacaaggcaaaatgccgtgtttatctcgtcaacttgttggcgagattttttcgact
(N)₁₆₋₂₆        caaaatcatgagacctttgtcttagatgattttgttccgttttacggcacaaatagagcagttgaacaaccgctctaaaaaagctga gRNA1 (N)16-26               TRACR tagttcgatcgaaggaaggtcgggcaggaagagggcctatttcccatgattccttcatatttgcatatacgatacaaggctgttagagagataattagaattaattt
atcaagctagcttccttccagcccgtccttctcccggataaagggtactaaggaagtataaacgtatatgctatgttccgacaatctctctattaatcttaattaaa

U6 gactgtaaacacaaagatattagtacaaaatacgtgacgtagaaagtaataatttcttgggtagtttgcagttttaaaattatgtttaaaatggactatcatatgc
ctgacatttgtgtttctataatcatgtttatgcactgcatctttcattattaaagaacccatcaaacgtcaaaattttaatacaaaattttacctgatagtatacg

U6 ttaccgtaacttgaaagtatttcgatttcttggctttatatatcttgtggaaaggacgaaacacc (N)₁₆₋₂₆        gttttagtactctggaaacaga
aatggcattgaacttcataaagctaaagaaccgaaatatatagaacacctttcctgctttgtgg (N)₁₆₋₂₆        caaaatcatgagacctttgtct U6                                                gRNA2 (N)16-26           TRACR

```
gcagctgctgaaagtgcagaaggcttaccaccagctggatcagagcttcatcgatacttatatcgacctgctggagactcggagaacctactatgagggaccaggag
cgtcgacgactttcacgtcttccgaatggtggtcgacctagtctcgaagtagctatgaatatagctggacgacctctgagcctcttggatgatactccctggtcctc
                                            SA Cas9
        |              |              |              |              |
      1,720          1,740          1,760          1,780          1,800 aagggagcccttcggatggaaagacatcaaggaatggtacgagatgctgatgggacattgcacctattttccagaagagctgagaagcgtcaagtacgcttataac
ttccctcggggaagcctacctttctgtagttccttaccatgctctacgactaccctgtaacgtggataaaaaggtcttctcgactcttcgcagttcatgcgaatattg
                                            SA Cas9
|              |              |              |              |              |
1,820          1,840          1,860          1,880          1,900          1,920 gcagatctgtacaacgccctgaatgacctgaacaacctggtcatcaccagggatgaaaacgagaaactggaatactatgagaagttccagatcatcgaaaacgtgtt
cgtctagacatgttgcgggacttactggacttgttggaccagtagtggtccctacttttgctctttgaccttatgatactcttcaaggtctagtagcttttgcacaa
                                            SA Cas9
        |              |              |              |              |
      1,940          1,960          1,980          2,000          2,020 taagcagaagaaaaagcctacactgaaacagattgctaaggagatcctggtcaacgaagaggacatcaagggctaccgggtgacaagcactggaaaaccagagttca
attcgtcttcttttttcggatgtgactttgtctaacgattcctctaggaccagttgcttctcctgtagttcccgatggcccactgttcgtgaccttttggtctcaagt
                                            SA Cas9
|              |              |              |              |              |
2,040          2,060          2,080          2,100          2,120          2,140 ccaatctgaaagtgtatcacgatatattaaggacatcacagcacggaaagaaatcattgagaacgccgaactgctggatcagattgctaagatcctgactatctaccag
ggttagactttcacatagtgctataattcctgtagtgtcgtgcctttctttagtaactcttgcggcttgacgacctagtctaacgattctaggactgatagatggtc
                                            SA Cas9
        |              |              |              |              |
      2,160          2,180          2,200          2,220          2,240 agctccgaggacatccaggaagagctgactaacctgaacagcgagctgacccaggaagagatcgaacagattagtaatctgaaggggtacaccggaacacacaacct
tcgaggctcctgtaggtccttctcgactgattggacttgtcgctcgactgggtccttctctagcttgtctaatcattagacttccccatgtggccttgtgtgttgga
                                            SA Cas9
|              |              |              |              |              |
2,260          2,280          2,300          2,320          2,340 gtccctgaaagctatcaatctgattctggatgagctgtggcatacaaacgacaatcagattgcaatctttaaccggctgaagctggtcccaaaaaaggtggacctga
cagggactttcgatagttagactaagacctactcgacaccgtatgtttgctgttagtctaacgttagaaattggccgacttcgaccagggttttttccacctggact
                                            SA Cas9
        |              |              |              |              |
      2,360          2,380          2,400          2,420          2,440          2,460 gtcagcagaaagagatcccaaccacactggtggacgatttcattctgtcacccgtggtcaagcggagcttcatccagagcatcaaagtgatcaacgccatcatcaag
cagtcgtctttctctagggttggtgtgaccacctgctaaagtaagacagtgggcaccagttcgcctcgaagtaggtctcgtagtttcactagttgcggtagtagttc
                                            SA Cas9
|              |              |              |              |              |
2,480          2,500          2,520          2,540          2,560
```

FIG. 22C

```
aagtacggcctgcccaatgatatcattatcgagctggctagggagaagaacagcaaggacgcacagaagatgatcaatgagatgcagaaacgaaaccggcagaccaa
ttcatgccggacgggttactatagtaatagctcgaccgatccctcttcttgtcgttcctgcgtgtcttctactagttactctacgtctttgctttggccgtctggtt
```
SA_Cas9

2,580   2,600   2,620   2,640   2,660

```
tgaacgcattgaagagattatccgaactaccgggaaagagaacgcaaagtacctgattgaaaaaatcaagctgcacgatatgcaggagggaaagtgtctgtattctc
acttgcgtaacttctctaataggcttgatggccccttttctcttgcgtttcatggactaactttttttagttcgacgtgctatacgtcctcccttcacagacataagag
```
SA_Cas9

2,680   2,700   2,720   2,740   2,760   2,780

```
tggaggccatcccccctggaggacctgctgaacaatccattcaactacgaggtcgatcatattatccccagaagcgtgtccttcgacaattccttaacaacaaggtg
acctccggtagggggacctcctggacgacttgttaggtaagttgatgctccagctagtataatagggg tcttcgcacaggaagctgttaaggaaattgttgttccac
```
SA_Cas9

2,800   2,820   2,840   2,860   2,880

```
ctggtcaagcaggaagagaactctaaaaagggcaataggactcctttccagtacctgtctagttcagattccaagatctcttacgaaacctttaaaaagcacattct
gaccagttcgtccttctcttgagattttccccgttatcctgaggaaaggtcatggacagatcaagtctaaggttctagagaatgctttggaaattttcgtgtaaga
```
SA_Cas9

2,900   2,920   2,940   2,960   2,980

```
gaatctggccaaaggaaaggccgcatcagcaagaccaaaaaggagtacctgctggaagagcgggacatcaacagattctccgtccagaaggatttttattaaccgga
cttagaccggtttccttccccggcgtagtcgttctggttttcctcatggacgaccttctcgccctgtagttgtctaagaggcaggtcttcctaaaataattggcct
```
SA_Cas9

3,000   3,020   3,040   3,060   3,080   3,100

```
atctggtggacacaagatacgctactcgcggcctgatgaatctgctgcgatcctatttccgggtgaacaatctggatgtgaaagtcaagtccatcaacggcgggttc
tagaccacctgtgttctatgcgatgagcgccggactacttagacgacgctaggataaaggcccacttgttagacctacactttcagttcaggtagttgccgcccaag
```
SA_Cas9

3,120   3,140   3,160   3,180   3,200

```
acatctttctgaggcgcaaatggaagtttaaaaaggagcgcaacaaagggtacaagcaccatgccgaagatgctctgattatcgcaaatgccgacttcatctttaa
tgtagaaaagactccgcgtttaccttcaaattttttcctcgcgttgtttcccatgttcgtggtacggcttctacgagactaatagcgtttacggctgaagtagaaatt
```
SA_Cas9

3,220   3,240   3,260   3,280   3,300

```
ggagtggaaaaagctggacaaagccaagaaagtgatggagaaccagatgttcgaagagaagcaggccgaatctatgcccgaaatcgagacagaacaggagtacaagg
cctcacctttttcgacctgtttcggttctttcactacctcttggtctacaagcttctcttcgtccggcttagatacgggctttagctctgtcttgtcctcatgttcc
```
SA_Cas9

3,320   3,340   3,360   3,380   3,400   3,420

FIG. 22D agattttcatcactcctcaccagatcaagcatatcaaggatttcaaggactacaagtactctcaccgggtggataaaaagcccaacagagagctgatcaatgacacc
tctaaaagtagtgaggagtggtctagttcgtatagttcctaaagttcctgatgttcatgagagtggcccacctatttttcgggttgtctctcgactagttactgtgg SA Cas9

3,440  3,460  3,480  3,500  3,520 ctgtatagtacaagaaaagacgataaggggaatacccctgattgtgaacaatctgaacggactgtacgacaaagataatgacaagctgaaaaagctgatcaacaaaag
gacatatcatgttcttttctgctattcccttatgggactaacacttgttagacttgcctgacatgctgtttctattactgttcgacttttttcgactagttgttttc SA Cas9

3,540  3,560  3,580  3,600  3,620 tcccgagaagctgctgatgtaccaccatgatcctcagacatatcagaaactgaagctgattatggagcagtacggcgacgagaagaacccactgtataagtactatg
agggctcttcgacgactacatggtggtactaggagtctgtatagtctttgacttcgactaataccctcgtcatgccgctgctcttcttgggtgacatattcatgatac SA Cas9

3,640  3,660  3,680  3,700  3,720  3,740 aagagactgggaactacctgaccaagtatagcaaaaaggataatggccccgtgatcaagaagatcaagtactatgggaacaagctgaatgcccatctggacatcaca
ttctctgacccttgatggactggttcatatcgttttcctattaccggggcactagttcttctagttcatgatacccttgttcgacttacgggtagacctgtagtgt SA Cas9

3,760  3,780  3,800  3,820  3,840 gacgattaccctaacagtcgcaacaaggtggtcaagctgtcactgaagccatacagattcgatgtctatctggacaacggcgtgtataaatttgtgactgtcaagaa
ctgctaatgggattgtcagcgttgttccaccagttcgacagtgacttcggtatgtctaagctacagatagacctgttgccgcacatatttaaacactgacagttctt SA Cas9

3,860  3,880  3,900  3,920  3,940 tctggatgtcatcaaaaaggagaactactatgaagtgaatagcaagtgctacgaagaggctaaaaagctgaaaaagattagcaaccaggcagagttcatcgcctcct
agacctacagtagttttttcctcttgatgatacttcacttatcgttcacgatgcttctccgattttttcgacttttttctaatcgttggtccgtctcaagtagcgagga SA Cas9

3,960  3,980  4,000  4,020  4,040  4,060 tttacaacaacgacctgattaagatcaatggcgaactgtatagggtcatcggggtgaacaatgatctgctgaaccgcattgaagtgaatatgattgacatcacttac
aaatgttgttgctggactaattctagttaccgcttgacatatcccagtagcccccacttgttactagacgacttggcgtaacttcacttatactaactgtagtgaatg SA Cas9

4,080  4,100  4,120  4,140  4,160 cgagagtatctggaaaacatgaatgataagcgccccccctcgaattatcaaaacaattgcctctaagactcagagtatcaaaaagtactcaaccgacattctgggaaa
gctctcatagaccttttgtacttactattcgcggggggagcttaatagttttgttaacggagattctgagtctcatagttttttcatgagttggctgtaagacccttt SA Cas9

```
cctgtatgaggtgaagagcaaaaagcaccctcagattatcaaaaagggcggatcccccaagaagaagaggaaagtctcgagcgactacaaagaccatgacggtgatt
ggacatactccacttctcgttttttcgtgggagtctaatagttttttcccgcctaggggggttcttcttctcctttcagagctcgctgatgtttctggtactgccactaa
```
                    SA Cas9                         NLS                      3XFLAG
```
         4,300         4,320         4,340         4,360         4,380
```

```
ataaagatcatgacatcgattacaaggatgacgatgacaagtagcaataaaggatcgtttattttcattggaagcgtgtgttggttttttgatcaggcgcgtccaag
tatttctagtactgtagctaatgttcctactgctactgttcatcgttatttcctagcaaataaaagtaaccttcgcacacaaccaaaaaactagtccgcgcaggttc
```
              3XFLAG                              mini pA
```
         4,400         4,420         4,440         4,460         4,480
```

```
cttcgcaggaaagaacatgtgagcaaaaggccagcaaaaggcgttaactctagatttaaatgcatgctggggagagatctaggaaccccctagtgatggagttggcca
gaagcgtcctttcttgtacactcgttttccggtcgttttccgcaattgagatctaaatttacgtacgaccctctctagatccttggggatcactacctcaaccggt
```
                                                              Right ITR
```
         4,500         4,520         4,540         4,560         4,580         4,600
```

```
ctccctctctgcgcgctcgctcgctcactgaggccgcccgggcaaagcccggcgtcgggcgacctttggtcgcccggcctcagtgagcgagcgagcgcgcagagag
gagggagagacgcgcgagcgagcgagtgactccggcgggcccgtttcgggcccgcagcccgctggaaaccagcgggccggagtcactcgctcgctcgcgcgtctctc
```
                              Right ITR
```
         4,620         4,640         4,660         4,680         4,700
```

```
ggagtggccaa
cctcaccggtt
```

```
4,710
```

FIG. 22F ttggccactccctctctgcgcgctcgctcgctcactgaggccgggcgaccaaaggtcgcccgacgcccgggctttgcccggcggcctcagtgagcgagcgagcgcg
aaccggtgagggagagacgcgcgagcgagcgagtgactccggcccgctggtttccagcgggctgcgggcccgaaacgggcccgccggagtcactcgctcgctcgcgc Left ITR 20    40    60    80    100 cagagagggagtggccaactccatcactagggggttcctcagatctgaattcggtaccaaggtcgggcaggaagagggcctatttcccatgattccttcatatttgca
gtctctccctcaccggttgaggtagtgatccccaaggagtctagacttaagccatggttccagcccgtccttctcccggataaagggtactaaggaagtataaacgt Left ITR    U6

120   140   160   180   200 tatacgatacaaggctgttagagagataattagaattaatttgactgtaaacacaaagatattagtacaaaatacgtgacgtagaaagtaataatttcttgggtagt
atatgctatgttccgacaatctctctattaatcttaatttaaactgacatttgtgtttctataatcatgttttatgcactgcatctttcattattaaagaacccatca

U6

220   240   260   280   300   320 ttgcagttttaaaattatgttttaaaatggactatcatatgcttaccgtaacttgaaagtatttcgatttcttggctttatatatcttgtggaaaggacgaaacacc
aacgtcaaaattttaatacaaaattttacctgatagtatacgaatggcattgaacttcataaagctaaagaaccgaaatatatagaacacctttcctgctttgtgg

U6

340   360   380   400   420

(N)16-26         gttttagtactctggaaacagaatctactaaaacaaggcaaaatgccgtgtttatctcgtcaacttgttggcgagatttttcgact
(N)16-26         caaaatcatgagacctttgtcttagatgattttgttccgttttacggcacaaatagagcagttgaacaaccgctctaaaaaagctga gRNA1 (N)16-26    TRACR 440   460   480   500   520 tagttcgatcgaaggaaggtcgggcaggaagagggcctatttcccatgattccttcatatttgcatatacgatacaaggctgttagagagataattagaattaattt
atcaagctagcttccttccagcccgtccttctcccggataaagggtactaaggaagtataaacgtatatgctatgttccgacaatctctctattaatcttaattaaa

U6

540   560   580   600   620   640 gactgtaaacacaaagatattagtacaaaatacgtgacgtagaaagtaataatttcttgggtagtttgcagttttaaaattatgttttaaaatggactatcatatgc
ctgacatttgtgtttctataatcatgttttatgcactgcatctttcattattaaagaacccatcaaacgtcaaaattttaatacaaaattttacctgatagtatacg

U6

660   680   700   720   740 ttaccgtaacttgaaagtatttcgatttcttggctttatatatcttgtggaaaggacgaaacacc    (N)16-26    gttttagtactctggaaacaga
aatggcattgaacttcataaagctaaagaaccgaaatatatagaacacctttcctgctttgtgg    (N)16-26    caaaatcatgagacctttgtct U6            gRNA2 (N)16-26    TRACR 760   780   800   820   840

FIG. 23A

```
atctactaaaacaaggcaaaatgccgtgtttatctcgtcaacttgttggcgagattttttggtaccgctagcgcttaagtcgcgatgtacgggccagatatacgcgt
tagatgattttgttccgttttacggcacaaatagagcagttgaacaaccgctctaaaaaaccatggcgatcgcgaattcagcgctacatgcccggtctatatgcgca
                    RACR
........|.........|.........|.........|.........|.........|.........|.........|.........|.........|
       860       880       900       920       940       960 tgacattgattattgactagtAGGTAGGAAGTGGCCTTTAACTCCATAGACCCTATTTAAACAGCTTCGGACAGGTTTAAACATCTCCTTGGATAATTCCTAGTATC
actgtaactaataactgatcaTCCATCCTTCACCGGAAATTGAGGTATCTGGGATAAATTTGTCGAAGCCTGTCCAAATTTGTAGAGGAACCTATTAAGGATCATAG
                                          hNRL Enhancer
                                          hNRL Promoter
........|.........|.........|.........|.........|.........|.........|.........|.........|.........|
       980      1,000     1,020     1,040     1,060

CCTGTTCCCACTCCTACTCAGGGATGATAGCTCTAAGAGGTGTTAGGGGATTAGGCTGAAAATGTAGGTCACCCCTCAGCCATCTGGGAACTAGAATGAGTGAGAGA
GGACAAGGGTGAGGATGAGTCCCTACTATCGAGATTCTCCACAATCCCCTAATCCGACTTTTACATCCAGTGGGGAGTCGGTAGACCCTTGATCTTACTCACTCTCT
                                          hNRL Enhancer
                                          hNRL Promoter
........|.........|.........|.........|.........|.........|.........|.........|.........|.........|
     1,080      1,100     1,120     1,140     1,160

GGAGAGAGGGGCAGAGACACACACATTCGCATATTAAGGTGACGCGTGTGGCCTCGAACACCGAGCGACCCTGCAGCGACCCGCTTAAgcggccgctaatacgactc
CCTCTCTCCCCGTCTCTGTGTGTGTAAGCGTATAATTCCACTGCGCACACCGGAGCTTGTGGCTCGCTGGGACGTCGCTGGGCGAATTcgccggcgattatgctgag
          hNRL Enhancer                    hTK minimal promoter
                                           hNRL Promoter
........|.........|.........|.........|.........|.........|.........|.........|.........|.........|
     1,180      1,200     1,220     1,240     1,260     1,280 actatagggagagccgccaccatgccgaagaaaaagcgcaaggtcgaagcgtccatgaaaaggaactacattctggggctggacatcgggattacaagcgtggggta
tgatatccctctcggcggtggtacggcttcttttttcgcgttccagcttcgcaggtacttttccttgatgtaagaccccgacctgtagccctaatgttcgcaccccat
                                 NLS                                    SA Cas9
........|.........|.........|.........|.........|.........|.........|.........|.........|.........|
     1,300      1,320     1,340     1,360     1,380 tgggattattgactatgaaacaagggacgtgatcgacgcaggcgtcagactgttcaaggaggccaacgtggaaaacaatgagggacggagaagcaagaggggagcca
acccctaataactgatactttgttccctgcactagctgcgtccgcagtctgacaagttcctccggttgcacctttttgttactccctgcctcttcgttctcccctcggt
                                          SA Cas9
........|.........|.........|.........|.........|.........|.........|.........|.........|.........|
     1,400      1,420     1,440     1,460     1,480 ggcgcctgaaacgacggagaaggcacagaatccagagggtgaagaaactgctgttcgattacaacctgctgaccgaccattctgagctgagtggaattaatcctat
ccgcggactttgctgcctcttccgtgtcttaggtctcccacttctttgacgacaagctaatgttggacgactggctggtaagactcgactcaccttaattaggaata
                                          SA Cas9
........|.........|.........|.........|.........|.........|.........|.........|.........|.........|
     1,500      1,520     1,540     1,560     1,580     1,600 gaagccagggtgaaaggcctgagtcagaagctgtcagaggaagagttttccgcagctctgctgcacctggctaagcgccgaggagtgcataacgtcaatgaggtgga
cttcggtcccactttccggactcagtcttcgacagtctccttctcaaaaggcgtcgagacgacgtggaccgattcgcggctcctcacgtattgcagttactccacct
                                          SA Cas9
........|.........|.........|.........|.........|.........|.........|.........|.........|.........|
     1,620      1,640     1,660     1,680     1,700
```

FIG. 23B agaggacaccggcaacgagctgtctacaaaggaacagatctcacgcaatagcaaagctctggaagagaagtatgtcgcagagctgcagctggaacggctgaagaaag
tctcctgtggccgttgctcgacagatgtttccttgtctagagtgcgttatcgtttcgagaccttctcttcatacagcgtctcgacgtcgaccttgccgacttctttc 1,720　1,740　1,760　1,780　1,800 atggcgaggtgagagggtcaattaataggttcaagacaagcgactacgtcaaagaagccaagcagctgctgaaagtgcagaaggcttaccaccagctggatcagagc
taccgctccactctcccagttaattatccaagttctgttcgctgatgcagtttcttcggttcgtcgacgactttcacgtcttccgaatggtggtcgacctagtctcg 1,820　1,840　1,860　1,880　1,900　1,920 ttcatcgatacttatatcgacctgctggagactcggagaacctactatgagggaccaggagaagggagccccttcggatggaaagacatcaaggaatggtacgagat
aagtagctatgaatatagctggacgacctctgagcctcttggatgatactcccggtcctcttccctcggggaagcctacctttctgtagttccttaccatgctcta 1,940　1,960　1,980　2,000　2,020 gctgatgggacattgcacctatttccagaagagctgagaagcgtcaagtacgcttataacgcagatctgtacaacgccctgaatgacctgaacaacctggtcatca
cgactaccctgtaacgtggataaaaaggtcttctcgactcttcgcagttcatgcgaatattgcgtctagacatgttgcgggacttactggacttgttggaccagtagt 2,040　2,060　2,080　2,100　2,120　2,140 ccagggatgaaaacgagaaactggaatactatgagaagttccagatcatcgaaaacgtgtttaagcagaagaaaaagcctacactgaaacagattgctaaggagatc
ggtcccctacttttgctcttttgacctatgatactcttcaaggtctagtagcttttgcacaaaattcgtcttcttttcggatgtgactttgtctaacgattcctctag 2,160　2,180　2,200　2,220　2,240 ctggtcaacgaagaggacatcaagggctaccgggtgacaagcactggaaaaccagagttcaccaatctgaaagtgtatcacgatattaaggacatcacagcacggaa
gaccagttgcttctcctgtagttcccgatggcccactgttcgtgacctttggtctcaagtggttagactttcacatagtgctataattcctgtagtgtcgtgcctt 2,260　2,280　2,300　2,320　2,340 agaaatcattgagaacgccgaactgctggatcagattgctaagatcctgactatctaccagagctccgaggacatccaggaagagctgactaacctgaacagcgagc
tctttagtaactcttgcggcttgacgacctagtctaacgattctaggactgatagatggtctcgaggctcctgtaggtccttctcgactgattggacttgtcgctcg 2,360　2,380　2,400　2,420　2,440　2,460 tgacccaggaagagatcgaacagattagtaatctgaaggggtacaccggaacacacaacctgtccctgaaagctatcaatctgattctggatgagctgtggcataca
actgggtccttctctagcttgtctaatcattagacttccccatgtggccttgtgtgttggacagggacttcgatagttagactaagacctactcgacaccgtatgt 2,480　2,500　2,520　2,540　2,560

FIG. 23C

```
aacgacaatcagattgcaatctttaaccggctgaagctggtcccaaaaaaggtggacctgagtcagcagaaagagatcccaaccacactggtggacgatttcattct
ttgctgttagtctaacgttagaaattggccgacttcgaccaggqttttttccacctqqactcaqtcqtctttctctagqqttqqtgtgaccacctqctaaagtaaga
```

2,580  2,600  2,620  2,640  2,660

```
gtcacccgtggtcaagcggagcttcatccagagcatcaaagtgatcaacgccatcatcaagaagtacggcctgcccaatgatatcattatcgagctggctagggaga
cagtgggcaccagttcgcctcgaagtaggtctcgtagtttcactagttgcggtagtagttcttcatgccggacgggttactatagtaatagctcgaccgatccctct
```

2,680  2,700  2,720  2,740  2,760  2,780

```
agaacagcaaggacgcacagaagatgatcaatgagatgcagaaacgaaaccggcagaccaatgaacgcattgaagagattatccgaactaccgggaaagagaacgca
tcttgtcgttcctgcgtgtcttctactagttactctacgtctttgctttggccgtctggttacttgcgtaacttctctaataggcttgatggcccttctcttgcgt
```

2,800  2,820  2,840  2,860  2,880

```
aagtacctgattgaaaaaatcaagctgcacgatatgcaggagggaaagtgtctgtattctctggaggccatcccccctggaggacctgctgaacaatccattcaacta
ttcatggactaacttttttagttcgacgtgctatacgtcctcccttcacagacataagagacctccggtaggqqgacctcctggacgacttgttaggtaagttgat
```

2,900  2,920  2,940  2,960  2,980

```
cgaggtcgatcatattatccccagaagcgtgtccttcgacaattccttaacaacaaggtgctggtcaagcaggaagagaactctaaaaagggcaataggactcctt
gctccagctagtataataggggtcttcgcacaggaagctgttaaggaaattgttgttccacgaccagttcgtccttctcttgagatttttcccgttatcctgaggaa
```

3,000  3,020  3,040  3,060  3,080  3,100

```
tccagtacctgtctagttcagattccaagatctcttacgaaaccttttaaaaagcacattctgaatctggccaaaggaaagggccgcatcagcaagaccaaaaaggag
aggtcatggacagatcaagtctaaggttctagagaatgcttggaaattttcgtgtaagacttagaccggtttcctttcccggcgtagtcgttctggttttccctc
```

3,120  3,140  3,160  3,180  3,200

```
tacctgctggaagagcgggacatcaacagattctccgtccagaaggatttattaaccggaatctggtggacacaagatacgctactcgcggcctgatgaatctgct
atggacgaccttctcgccctgtagttgtctaagaggcaggtcttcctaaaataattggccttagaccacctgtgttctatgcgatgagcgccggactacttagacga
```

3,220  3,240  3,260  3,280  3,300

```
gcgatcctatttccgggtgaacaatctggatgtgaaagtcaagtccatcaacggcgggttcacatcttttctgagqcgcaaatggaagtttaaaaaggagcgcaaca
cgctaggataaaggcccacttgttagacctacactttcagttcaggtagttgccgcccaagtgtagaaaagactccgcgtttaccttcaaattttttcctcgcgttgt
```

```
aagggtacaagcaccatgccgaagatgctctgattatcgcaaatgccgacttcatctttaaggagtggaaaaagctggacaaagccaagaaagtgatggagaaccag
ttcccatgttcgtggtacggcttctacgagactaatagcgtttacggctgaagtagaaattcctcaccttttcgacctgtttcggttctttcactacctcttggtc
```
3,440   3,460   3,480   3,500   3,520

```
atgttcgaagagaagcaggccgaatctatgcccgaaatcgagacagaacaggagtacaaggagattttcatcactcctccaccagatcaagcatatcaaggatttcaa
tacaagcttctcttcgtccggcttagatacgggctttagctctgtcttgtcctcatgttcctctaaaagtagtgaggagtggtctagttcgtatagttcctaaagtt
```
3,540   3,560   3,580   3,600   3,620

```
ggactacaagtactctcaccgggtggataaaaagcccaacagagagctgatcaatgacaccctgtatagtacaagaaaagacgataaggggaatacccctgattgtga
cctgatgttcatgagagtggcccacctattttttcgggttgtctctcgactagttactgtgggacatatcatgttcttttctgctattcccttatgggactaacact
```
3,640   3,660   3,680   3,700   3,720   3,740

```
acaatctgaacggactgtacgacaaagataatgacaagctgaaaaagctgatcaacaaaagtcccgagaagctgctgatgtaccaccatgatcctcagacatatcag
tgttagacttgcctgacatgctgtttctattactgttcgacttttttcgactagttgttttcagggctcttcgacgactacatggtggtactaggagtctgtatagtc
```
3,760   3,780   3,800   3,820   3,840

```
aaactgaagctgattatggagcagtacggcgacgagaagaacccactgtataagtactatgaagagactgggaactacctgaccaagtatagcaaaaaggataatgg
tttgacttcgactaataccctcgtcatgccgctgctcttcttgggtgacatattcatgatacttctctgacccttgatggactggttcatatcgttttcctattacc
```
3,860   3,880   3,900   3,920   3,940

```
ccccgtgatcaagaagatcaagtactatgggaacaagctgaatgcccatctggacatcacagacgattaccctaacagtcgcaacaaggtggtcaagctgtcactga
ggggcactagttcttctagttcatgatacccttgttcgacttacgggtagacctgtagtgtctgctaatgggattgtcagcgttgttccaccagttcgacagtgact
```
3,960   3,980   4,000   4,020   4,040   4,060

```
agccatacagattcgatgtctatctggacaacggcgtgtataaatttgtgactgtcaagaatctggatgtcatcaaaaaggagaactactatgaagtgaatagcaag
tcggtatgtctaagctacagatagacctgttgccgcacatatttaaacactgacagttcttagacctacagtagttttttcctcttgatgatacttcacttatcgttc
```
4,080   4,100   4,120   4,140   4,160

```
tgctacgaagaggctaaaaagctgaaaaagattagcaaccaggcagagttcatcgcctccttttacaacaacgacctgattaagatcaatggcgaactgtatagggt
acgatgcttctccgattttttcgacttttttctaatcgttggtccgtctcaagtagcggaggaaaatgttgttgctggactaattctagttaccgcttgacatatccca
```
4,180   4,200   4,220   4,240   4,260   4,280

FIG. 23E

```
catcggggtgaacaatgatctgctgaaccgcattgaagtgaatatgattgacatcacttaccgagagtatctggaaaacatgaatgataagcgccccccctcgaatta
gtagcccacttgttactagacgacttggcgtaacttcacttatactaactgtagtgaatggctctcatagaccttttgtacttactattcgcgggggagcttaat
```

```
tcaaaacaattgcctctaagactcagagtatcaaaaagtactcaaccgacattctgggaaacctgtatgaggtgaagagcaaaaagcaccctcagattatcaaaaag
agttttgttaacggagattctgagtctcatagttttcatgagttggctgtaagacccttggacatactccacttctcgttttcgtgggagtctaatagttttc
```

```
ggcggatcccccaagaagaagaggaaagtctcgagcgactacaaagaccatgacggtgattataaagatcatgacatcgattacaaggatgacgatgacaagtagca
ccgcctaggggttcttcttctcctttcagagctcgctgatgtttctggtactgccactaatatttctagtactgtagctaatgttcctactgctactgttcatcgt
```

```
ataaaggatcgtttattttcattggaagcgtgtgttggttttttgatcaggcgcgtccaagcttcgcaggaaagaacatgtgagcaaaaggccagcaaaaggcgtta
tatttcctagcaaataaaagtaaccttcgcacacaaccaaaaaactagtccgcgcaggttcgaagcgtccttttcttgtacactcgttttccggtcgttttccgcaat
```

```
actctagatttaaatgcatgctggggagagatctaggaacccctagtgatggagttggccactccctctctgcgcgctcgctcgctcactgaggccgcccgggcaaa
tgagatctaaatttacgtacgaccccctctctagatccttggggatcactacctcaaccggtgagggagagacgcgcgagcgagcgagtgactccggcgggcccgttt
```

```
gcccggcgtcggcgacctttggtcgcccggcctcagtgagcgagcgagcgcgcagagagggagtggccaa
cgggcccgcagcccgctggaaaccagcgggccggagtcactcgctcgctcgcgcgtctctccctcaccggtt
```

FIG. 23F atctactaaaacaaggcaaaatgccgtgtttatctcgtcaacttgttggcgagattttttggtaccgctagcgcttaagtcgcgatgtacgggccagatatacgcgt
tagatgattttgttccgttttacggcacaaatagagcagttgaacaaccgctctaaaaaaccatggcgatcgcgaattcagcgctacatgcccggtctatatgcgca

*BACR* tgacattgattattgactagtATTTTAATCTCACTAGGGTTCTGGGAGCACCCCCCCCCACCGCTCCCGCCCTCCACAAAGCTCCTGGGCCCCTCCTCCCTTCAAGG
actgtaactaataactgatcaTAAAATTAGAGTGATCCCAAGACCCTCGTGGGGGGGGGTGGCGAGGGCGGGAGGTGTTTCGAGGACCCGGGGAGGAGGGAAGTTCC

*hRCVRN Promoter*

ATTGCGAAGAACTGGTCGCAAATCCTCCTAAGCCACCAGCATCTCGGTCTTCAGCTCACACCAGCCTTGAGCCCAGCCTGCGGCCAGGGGACCACGCACGTCCCACC
TAACGCTTCTTGACCAGCGTTTAGGAGGATTCGGTGGTCGTAGAGCCAGAAGTCGAGTGTGGTCGGAACTCGGGTCGGACGCCGGTCCCCTGGTGCGTGCAGGGTGG

*hRCVRN Promoter*

CACCCAGCGACTCCCCAGCCGCTGCCCACTCTTCCTCACTCAgcggccgctaatacgactcactatagggagagccgccaccatgccgaagaaaaagcgcaaggtcg
GTGGGTCGCTGAGGGGTCGGCGACGGGTGAGAAGGAGTGAGTcgccggcgattatgctgagtgatatccctctcggcggtggtacggcttcttttttcgcgttccagc

*hRCVRN Promoter*                                                                    *N.S* aagcgtccatgaaaaggaactacattctggggctggacatcgggattacaagcgtggggtatgggattattgactatgaaacaagggacgtgatcgacgcaggcgtc
ttcgcaggtacttttccttgatgtaagaccccgacctgtagccctaatgttcgcaccccataccctaataactgatactttgttccctgcactagctgcgtccgcag

*NLS*  *SA Cas9* agactgttcaaggaggccaacgtggaaaacaatgagggacggagaagcaagaggggagccaggcgcctgaaacgacggagaaggcacagaatccagagggtgaagaa
tctgacaagttcctccggttgcaccttttgttactccctgcctcttcgttctcccctcggtccgcggactttgctgcctcttccgtgtcttaggtctcccacttctt

*SA Cas9* actgctgttcgattacaacctgctgaccgaccattctgagctgagtggaattaatccttatgaagccagggtgaaaggcctgagtcagaagctgtcagaggaagagt
tgacgacaagctaatgttggacgactggctggtaagactcgactcacccttaattaggaatacttcggtcccactttccggactcagtcttcgacagtctcctcctca

*SA Cas9* tttccgcagctctgctgcacctggctaagcgccgaggagtgcataacgtcaatgaggtggaagaggacaccggcaacgagctgtctacaaaggaacagatctcacgc
aaaggcgtcgagacgacgtggaccgattcgcggctcctcacgtattgcagttactccacccttctcctgtggccgttgctcgacagatgtttccttgtctagagtgcg

*SA Cas9*

FIG. 24B aatagcaaagctctggaagagaagtatgtcgcagagctgcagctggaacggctgaagaaagatggcgaggtgagagggtcaattaataggttcaagacaagcgacta
ttatcgtttcgagaccttctcttcatacagcgtctcgacgtcgaccttgccgacttctttctaccgctccactctcccagttaattatccaagttctgttcgctgat

```
         1,720         1,740         1,760         1,780         1,800
``` cgtcaaagaagccaagcagctgctgaaagtgcagaaggcttaccaccagctggatcagagcttcatcgatacttatatcgacctgctggagactcggagaacctact
gcagtttcttcggttcgtcgacgactttcacgtcttccgaatggtggtcgacctagtctcgaagtagctatgaatatagctggacgacctctgagcctcttggatga

```
1,820         1,840         1,860         1,880         1,900         1,920
``` atgagggaccaggagaagggagccccttcggatggaaagacatcaaggaatggtacgagatgctgatgggacattgcacctatttccagaagagctgagaagcgtc
tactccctggtcctcttccctcggggaagcctacctttctgtagttccttaccatgctctacgactaccctgtaacgtggataaaaggtcttctcgactcttcgcag

```
         1,940         1,960         1,980         2,000         2,020
``` aagtacgcttataacgcagatctgtacaacgccctgaatgacctgaacaacctggtcatcaccagggatgaaaacgagaaactggaatactatgagaagttccagat
ttcatgcgaatattgcgtctagacatgttgcgggacttactggacttgttggaccagtagtggtccctacttttgctctttgaccttatgatactcttcaaggtcta

```
2,040         2,060         2,080         2,100         2,120         2,140
``` catcgaaaacgtgtttaagcagaagaaaaagcctacactgaaacagattgctaaggagatcctggtcaacgaagaggacatcaagggctaccgggtgacaagcactg
gtagcttttgcacaaattcgtcttcttttttcggatgtgactttgtctaacgattcctctaggaccagttgcttctcctgtagttcccgatgcccactgttcgtgac

```
         2,160         2,180         2,200         2,220         2,240
``` gaaaaccagagttcaccaatctgaaagtgtatcacgatattaaggacatcacagcacggaaagaaatcattgagaacgccgaactgctggatcagattgctaagatc
cttttggtctcaagtggttagactttcacatagtgctataattcctgtagtgtcgtgcctttctttagtaactcttgcggcttgacgacctagtctaacgattctag

```
2,260         2,280         2,300         2,320         2,340
``` ctgactatctaccagagctccgaggacatccaggaagagctgactaacctgaacagcgagctgacccaggaagagatcgaacagattagtaatctgaaggggtacac
gactgatagatggtctcgaggctcctgtaggtccttctcgactgattggacttgtcgctcgactgggtccttctctagcttgtctaatcattagacttccccatgtg

```
         2,360         2,380         2,400         2,420         2,440         2,460
``` cggaacacacaacctgtccctgaaagctatcaatctgattctggatgagctgtggcatacaaacgacaatcagattgcaatctttaaccggctgaagctggtcccaa
gccttgtgtgttggacagggactttcgatagttagactaagacctactcgacaccgtatgtttgctgttagtctaacgttagaaattggccgacttcgaccagggtt

FIG. 24E attgacatcacttaccgagagtatctggaaaacatgaatgataagcgccccctcgaattatcaaaacaattgcctctaagactcagagtatcaaaaagtactcaac
taactgtagtgaatggctctcatagaccttttgtacttactattcgcggggggagcttaatagttttgttaacggagattctgagtctcatagttttcatgagttg cgacattctgggaaacctgtatgaggtgaagagcaaaaagcaccctcagattatcaaaaagggcggatccccaagaagaagaggaaagtctcgagcgactacaaag
gctgtaagacccttttggacatactccacttctcgttttcgtgggagtctaatagttttccccgcctaggggttcttcttctcctttcagagctcgctgatgttc accatgacggtgattataaagatcatgacatcgattacaaggatgacgatgacaagtagcaataaaggatcgtttatttcattggaagcgtgtgttggtttttga
tggtactgccactaatatttctagtactgtagctaatgttcctactgctactgttcatcgttatttcctagcaaataaaagtaaccttcgcacacaaccaaaaaact tcaggcgcgtccaagcttcgcaggaaagaacatgtgagcaaaaggccagcaaaaggcgttaactctagatttaaatgcatgctggggagagatctaggaaccctag
agtccgcgcaggttcgaagcgtcctttcttgtacactcgttttccggtcgttttccgcaattgagatctaaatttacgtacgacccctctctagatccttggggatc tgatggagttggccactccctctctgcgcgctcgctcgctcactgaggccgcccgggcaaagcccgggcgtcgggcgacctttggtcgcccggcctcagtgagcgag
actacctcaaccggtgagggagagacgcgcgagcgagcgagtgactccggcgggcccgtttcgggcccgcagcccgctggaaaccagcgggccggagtcactcgctc cgagcgcgcagagagggagtggccaa
gctcgcgcgtctctccctcaccggtt

FIG. 24F

CRISPR/CAS-RELATED METHODS AND COMPOSITIONS FOR TREATING LEBER'S CONGENITAL AMAUROSIS 10 (LCA10)

CROSS-REFERENCE TO RELATED APPLICATIONS

The present application claims the benefit of U.S. Provisional Application No. 61/950,733, filed Mar. 10, 2014, and U.S. Provisional Application No. 62/036,576, filed Aug. 12, 2014, the contents of which are hereby incorporated by reference in their entirety.

SEQUENCE LISTING

The instant application contains a Sequence Listing which has been submitted electronically in ASCII format and is hereby incorporated by reference in its entirety. Said ASCII copy, created on May 21, 2015, is named 2015-05-21 C2159-701010_ST25.txt and is 1,637,048 bytes in size.

FIELD OF THE INVENTION

The invention relates to CRISPR/CAS-related methods and components for editing of a target nucleic acid sequence, and applications thereof in connection with Leber's Congenital Amaurosis 10 (LCA10).

BACKGROUND

Leber's congenital amaurosis (LCA) is the most severe form of inherited retinal dystrophy, with an onset of disease symptoms in the first years of life (Leber, T., Archiv für Ophthalmologie (in German). 15 (3): 1-25, 1869) and an estimated prevalence of approximately 1 in 50,000 worldwide (Koenekoop et al., Clin Experiment Ophthalmol. 35(5): 473-485, 2007; Stone, Am J Ophthalmol. 144(6): 791-811, 2007). Genetically, LCA is a heterogeneous disease. To date, fifteen genes have been identified with mutations that result in LCA (den Hollander et al., Prog Retin Eye Res. 27(4): 391-419, 2008; Estrada-Cuzcano et al., Invest Ophthalmol Vis Sci. 52(2): 834-9, 2011). The CEP290 gene is the most frequently mutated LCA gene accounting for approximately 15% of all cases (Stone, Am J Ophthalmol. 144(6): 791-811, 2007; den Hollander et al., Prog Retin Eye Res. 27(4): 391-419, 2008; den Hollander et al., Am J Hum Genet. 79(3): 556-561, 2006; Perrault et al., Hum Mutat. 28(4):4 16, 2007). Severe mutations in CEP290 have also been reported to cause systemic diseases that are characterized by brain defects, kidney malformations, polydactyly and/or obesity (Baal et al., Am J Hum Genet. 81, 170-179, 2007; den Hollander et al., Prog Retin Eye Res. 27(4): 391-419, 2008; Helou et al., J Med Genet. 44: 657-663, 2007; Valente et al., Nat Genet. 38: 623-625, 2006). Patients with LCA and early-onset retinal dystrophy often carry hypomorphic CEP290 alleles (Stone, Am J Ophthalmol. 144(6): 791-811, 2007; den Hollander et al., Am J Hum Genet. 79(3): 556-561, 2006; Perrault et al., Hum Mutat. 28(4):4 16, 2007; Coppieters et al., Hum Mutat 31, E1709-E1766. 2010; Littink et al., Invest Ophthalmol Vis Sci 51, 3646-3652, 2010).

LCA, and other retinal dystrophies such as Retinitis Pigmentosa (RP), have long been considered incurable diseases. However, the first phase I/II clinical trials using gene augmentation therapy have led to promising results in a selected group of adult LCA/RP patients with mutations in the RPE65 gene (Bainbridge et al., N Engl J Med. 358, 2231-2239, 2008; Cideciyan et al., Proc Natl Acad Sci USA. 105, 15112-15117, 2008; Hauswirth et al., N Engl J Med. 358, 2240-2248, 2008; Maguire et al., N Engl J Med. 358: 2240-2248, 2008). Unilateral subretinal injections of adeno-associated virus particles carrying constructs encoding the wild-type RPE65 cDNA were shown to be safe and moderately effective in some patients, without causing any adverse effects. In a follow-up study including adults and children, visual improvements were more sustained, especially in the children all of whom gained ambulatory vision (Maguire et al., Lancet. 374, 1597-1605, 2009). Although these studies demonstrated the potential to treat LCA using gene augmentation therapy and increased the development of therapeutic strategies for other genetic subtypes of retinal dystrophies (den Hollander et al., J Clin Invest 120: 3042-3053, 2010), it is hard to control the expression levels of the therapeutic genes when using gene augmentation therapy.

Leber's congenital amaurosis 10 (LCA10), one type of LCA, is is an inherited (autosomal recessive) retinal degenerative disease characterized by severe loss of vision at birth. All subjects having LCA10 have had at least one c.2991+1655A to G (adenine to guanine) mutation in the CEP290 gene. Heterozygous nonsense, frameshift, and splice-site mutations have been identified on the remaining allele. A c.2991+1655A to G mutation in the CEP290 gene give rise to a cryptic splice donor cite in intron 26 which results in the inclusion of an aberrant exon of 128 bp in the mutant CEP290 mRNA, and inserts a premature stop codon (P.C998X). The sequence of the cryptic exon contains part of an Alu repeat. There are currently no approved therapeutics for LCA10.

Despite advances that have been made using gene therapy, there remains a need for therapeutics to treat retinal dystrophies, including LCA10.

SUMMARY OF THE INVENTION

Methods and compositions discussed herein, provide for treating or delaying the onset or progression of diseases of the eye, e.g., disorders that affect retinal cells, e.g., photoreceptor cells.

Methods and compositions discussed herein, provide for treating or delaying the onset or progression of Leber's Congenital Amaurosis 10 (LCA10), an inherited retinal degenerative disease characterized by severe loss of vision at birth. LCA10 is caused by a mutation in the CEP290 gene, e.g., a c.2991+1655A to G (adenine to guanine) mutation in the CEP290 gene which gives rise to a cryptic splice site in intron 26. This is a mutation at nucleotide 1655 of intron 26 of CEP290, e.g., an A to G mutation. CEP290 is also known as: CT87; MKS4; POC3; rd16; BBS14; JBTS5; LCA10; NPHP6; SLSN6; and 3H11Ag.

Methods and compositions discussed herein, provide for treating or delaying the onset or progression of LCA10 by gene editing, e.g., using CRISPR-Cas9 mediated methods to alter a LCA10 target position, as disclosed below.

"LCA10 target position", as used herein, refers to nucleotide 1655 of intron 26 of the CEP290 gene, and the mutation at that site that gives rise to a cryptic splice donor site in intron 26 which results in the inclusion of an aberrant exon of 128 bp (c.2991+1523 to c.2991+1650) in the mutant CEP290 mRNA, and inserts a premature stop codon (p.C998X). The sequence of the cryptic exon contains part of an Alu repeat region. The Alu repeats span from c.2991+1162 to c.2991+1638. In an embodiment, the LCA10 target position is occupied by an adenine (A) to guanine (G) mutation (c.2991+1655A to G).

In one aspect, methods and compositions discussed herein, provide for altering a LCA10 target position in the CEP290 gene. The methods and compositions described herein introduce one or more breaks near the site of the LCA target position (e.g., c.2991+1655A to G) in at least one allele of the CEP290 gene. Altering the LCA10 target position refers to (1) break-induced introduction of an indel (also referred to herein as NHEJ-mediated introduction of an indel) in close proximity to or including a LCA10 target position (e.g., c.2991+1655A to G), or (2) break-induced deletion (also referred to herein as NHEJ-mediated deletion) of genomic sequence including the mutation at a LCA10 target position (e.g., c.2991+1655A to G). Both approaches give rise to the loss or destruction of the cryptic splice site resulting from the mutation at the LCA10 target position (e.g., c.2991+1655A to G).

In an embodiment, a single strand break is introduced in close proximity to or at the LCA10 target position (e.g., c.2991+1655A to G) in the CEP290 gene. While not wishing to be bound by theory, it is believed that break-induced indels (e.g., indels created following NHEJ) destroy the cryptic splice site. In an embodiment, the single strand break will be accompanied by an additional single strand break, positioned by a second gRNA molecule.

In an embodiment, a double strand break is introduced in close proximity to or at the LCA10 target position (e.g., c.2991+1655A to G) in the CEP290 gene. While not wishing to be bound by theory, it is believed that break-induced indels (e.g., indels created following NHEJ) destroy the cryptic splice site. In an embodiment, a double strand break will be accompanied by an additional single strand break may be positioned by a second gRNA molecule. In an embodiment, a double strand break will be accompanied by two additional single strand breaks positioned by a second gRNA molecule and a third gRNA molecule.

In an embodiment, a pair of single strand breaks is introduced in close proximity to or at the LCA10 target position (e.g., c.2991+1655A to G) in the CEP290 gene. While not wishing to be bound by theory, it is believed that break-induced indels destroy the cryptic splice site. In an embodiment, the pair of single strand breaks will be accompanied by an additional double strand break, positioned by a third gRNA molecule. In an embodiment, the pair of single strand breaks will be accompanied by an additional pair of single strand breaks positioned by a third gRNA molecule and a fourth gRNA molecule.

In an embodiment, two double strand breaks are introduced to flank the LCA10 target position in the CEP290 gene (one 5' and the other one 3' to the mutation at the LCA10 target position, e.g., c.2991+1655A to G) to remove (e.g., delete) the genomic sequence including the mutation at the LCA10 target position. It is contemplated herein that in an embodiment the break-induced deletion of the genomic sequence including the mutation at the LCA10 target position is mediated by NHEJ. In an embodiment, the breaks (i.e., the two double strand breaks) are positioned to avoid unwanted target chromosome elements, such as repeat elements, e.g., an Alu repeat. The breaks, i.e., two double strand breaks, can be positioned upstream and downstream of the LCA10 target position, as discussed herein.

In an embodiment, one double strand break (either 5' or 3' to the mutation at the LCA10 target position, e.g., c.2991+1655A to G) and two single strand breaks (on the other side of the mutation at the LCA10 target position from the double strand break) are introduced to flank the LCA10 target position in the CEP290 gene to remove (e.g., delete) the genomic sequence including the mutation at the LCA10 target position. It is contemplated herein that in an embodiment the break-induced deletion of the genomic sequence including the mutation at the LCA10 target position is mediated by NHEJ. In an embodiment, the breaks (i.e., the double strand break and the two single strand breaks) are positioned to avoid unwanted target chromosome elements, such as repeat elements, e.g., an Alu repeat. The breaks, e.g., one double strand break and two single strand breaks, can be positioned upstream and downstream of the LCA10 target position, as discussed herein.

In an embodiment, two pairs of single strand breaks (two 5' and the other two 3' to the mutation at the LCA10 target position, e.g., c.2991+1655A to G) are introduced to flank the LCA10 target position in the CEP290 gene to remove (e.g., delete) the genomic sequence including the mutation at the LCA10 target position. It is contemplated herein that in an embodiment the break-induced deletion of the genomic sequence including the mutation at the LCA10 target position is mediated by NHEJ. In an embodiment, the breaks (e.g., two pairs of single strand breaks) are positioned to avoid unwanted target chromosome elements, such as repeat elements, e.g., an Alu repeat. The breaks, e.g., two pairs of single strand breaks, can be positioned upstream or downstream of the LCA10 target position, as discussed herein.

The LCA10 target position may be targeted by cleaving with either a single nuclease or dual nickases, e.g., to induce break-induced indel in close proximity to or including the LCA10 target position or break-induced deletion of genomic sequence including the mutation at the LCA10 target position in the CEP290 gene. The method can include acquiring knowledge of the mutation carried by the subject, e.g., by sequencing the appropriate portion of the CEP290 gene.

In one aspect, disclosed herein is a gRNA molecule, e.g., an isolated or non-naturally occurring gRNA molecule, comprising a targeting domain which is complementary with a target domain from the CEP290 gene.

When two or more gRNAs are used to position two or more cleavage events, e.g., double strand or single strand breaks, in a target nucleic acid, it is contemplated that in an embodiment the two or more cleavage events may be made by the same or different Cas9 proteins. For example, when two gRNAs are used to position two double strand breaks, a single Cas9 nuclease may be used to create both double strand breaks. When two or more gRNAs are used to position two or more single stranded breaks (single strand breaks), a single Cas9 nickase may be used to create the two or more single strand breaks. When two or more gRNAs are used to position at least one double strand break and at least one single strand break, two Cas9 proteins may be used, e.g., one Cas9 nuclease and one Cas9 nickase. It is contemplated that in an embodiment when two or more Cas9 proteins are used that the two or more Cas9 proteins may be delivered sequentially to control specificity of a double strand versus a single strand break at the desired position in the target nucleic acid.

In some embodiments, the targeting domain of the first gRNA molecule and the targeting domain of the second gRNA molecule hybridize to the target domain from the target nucleic acid molecule (i.e., the CEP290 gene) through complementary base pairing to opposite strands of the target nucleic acid molecule. In some embodiments, the first gRNA molecule and the second gRNA molecule are configured such that the PAMs are oriented outward.

In an embodiment, the targeting domain of a gRNA molecule is configured to avoid unwanted target chromosome elements, such as repeat elements, e.g., an Alu repeat, or the endogenous CEP290 splice sites, in the target domain. The gRNA molecule may be a first, second, third and/or fourth gRNA molecule.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Table 10. In some embodiments, the targeting domain is selected from those in Table 10. For example, in certain embodiments, the targeting domain is:

```
GACACTGCCAATAGGGATAGGT;     (SEQ ID NO: 387)

GTCAAAAGCTACCGGTTACCTG;     (SEQ ID NO: 388)

GTTCTGTCCTCAGTAAAAGGTA;     (SEQ ID NO: 389)

GAATAGTTTGTTCTGGGTAC;       (SEQ ID NO: 390)

GAGAAAGGGATGGGCACTTA;       (SEQ ID NO: 391)

GATGCAGAACTAGTGTAGAC;       (SEQ ID NO: 392)

GTCACATGGGAGTCACAGGG;       (SEQ ID NO: 393)
or

GAGTATCTCCTGTTTGGCA.        (SEQ ID NO: 394)
```

In an embodiment, when two or more gRNAs are used to position two or more breaks, e.g., two or more single strand breaks in the target nucleic acid sequence, each guide RNA is independently selected from one of Table 10. In an embodiment, the two or more gRNAs or targeting domains are selected from one or more of the pairs of gRNAs or targeting domains described herein, e.g., as indicated in Table 10. In an embodiment, when two or more gRNAs are used to position four breaks, e.g., four single strand breaks in the target nucleic acid sequence, each guide RNA is independently selected from one of Table 10.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Table 1A-1D. In some embodiments, the targeting domain is selected from those in Table 1A-1D. For example, in certain embodiments, the targeting domain is:

```
GAGAUACUCACAAUUACAAC;       (SEQ ID NO: 395)
or

GAUACUCACAAUUACAACUG.       (SEQ ID NO: 396)
```

In an embodiment, when two or more gRNAs are used to position two or more breaks, e.g., two or more single strand breaks in the target nucleic acid sequence, each guide RNA is independently selected from one of Tables 1A-1D. In an embodiment, when two or more gRNAs are used to position four breaks, e.g., four single strand breaks in the target nucleic acid sequence, each guide RNA is independently selected from one of Tables 1A-1D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 2A-2C. In some embodiments, the targeting domain is selected from those in Tables 2A-2C. For example, in certain embodiments, the targeting domain is:

```
GAGAUACUCACAAUUACAAC;       (SEQ ID NO: 395)
or

GAUACUCACAAUUACAA.          (SEQ ID NO: 397)
```

In an embodiment, when two or more gRNAs are used to position two or more breaks, e.g., two or more single stranded breaks in the target nucleic acid sequence, each guide RNA is independently selected from one of Tables 2A-2C. In an embodiment, when two or more gRNAs are used to position four breaks, e.g., four single strand breaks in the target nucleic acid sequence, each guide RNA is independently selected from one of Tables 2A-2C.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 6A-6D. In some embodiments, the targeting domain is selected from those in Tables 6A-6D. For example, in certain embodiments, the targeting domain is:

```
GCACCUGGCCCCAGUUGUAAUU.     (SEQ ID NO: 398)
```

In an embodiment, when two or more gRNAs are used to position two or more breaks, e.g., two or more single stranded breaks in the target nucleic acid sequence, each guide RNA is independently selected from one of Tables 6A-6D. In an embodiment, when two or more gRNAs are used to position four breaks, e.g., four single strand breaks in the target nucleic acid sequence, each guide RNA is independently selected from one of Tables 6A-6D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 3A-3D. In some embodiments, the targeting domain is selected from those in Tables 3A-3D. For example, in certain embodiments, the targeting domain is:

```
GCUACCGGUUACCUGAA;          (SEQ ID NO: 457)

GCAGAACUAGUGUAGAC;          (SEQ ID NO: 458)

GUUGAGUAUCUCCUGUU;          (SEQ ID NO: 459)

GAUGCAGAACUAGUGUAGAC;       (SEQ ID NO: 460)
or

GCUUGAACUCUGUGCCAAAC.       (SEQ ID NO: 461)
```

In an embodiment, when two or more gRNAs are used to position two or more breaks, e.g., two or more single stranded breaks in the target nucleic acid sequence, each guide RNA is independently selected from one of Tables 3A-3D. In an embodiment, when two or more gRNAs are used to position four breaks, e.g., four single strand breaks in the target nucleic acid sequence, each guide RNA is independently selected from one of Tables 3A-3D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 7A-7D. In some embodiments, the targeting domain is selected from those in Tables 7A-7D. For example, in certain embodiments, the targeting domain is:

| | |
|---|---|
| GAAAGAUGAAAAAUACUCUU; | (SEQ ID NO: 462) |
| GAAAUAGAUGUAGAUUG; | (SEQ ID NO: 463) |
| GAAAUAUUAAGGGCUCUUCC; | (SEQ ID NO: 464) |
| GAACAAAAGCCAGGGACCAU; | (SEQ ID NO: 465) |
| GAACUCUAUACCUUUUACUG; | (SEQ ID NO: 466) |
| GAAGAAUGGAAUAGAUAAUA; | (SEQ ID NO: 467) |
| GAAUAGUUUGUUCUGGGUAC; | (SEQ ID NO: 468) |
| GAAUGGAAUAGAUAAUA; | (SEQ ID NO: 469) |
| GAAUUUACAGAGUGCAUCCA; | (SEQ ID NO: 470) |
| GAGAAAAAGGAGCAUGAAAC; | (SEQ ID NO: 471) |
| GAGAGCCACAGUGCAUG; | (SEQ ID NO: 472) |
| GAGGUAGAAUCAAGAAG; | (SEQ ID NO: 473) |
| GAGUGCAUCCAUGGUCC; | (SEQ ID NO: 474) |
| GAUAACUACAAAGGGUC; | (SEQ ID NO: 475) |
| GAUAGAGACAGGAAUAA; | (SEQ ID NO: 476) |
| GAUGAAAAAUACUCUUU; | (SEQ ID NO: 477) |
| GAUGACAUGAGGUAAGU; | (SEQ ID NO: 478) |
| GAUGCAGAACUAGUGUAGAC; | (SEQ ID NO: 460) |
| GCAGAACUAGUGUAGAC; | (SEQ ID NO: 458) |
| GCAUGUGGUGUCAAAUA; | (SEQ ID NO: 479) |
| GCCUGAACAAGUUUUGAAAC; | (SEQ ID NO: 480) |
| GCUACCGGUUACCUGAA; | (SEQ ID NO: 457) |
| GCUCUUUUCUAUAUAUA; | (SEQ ID NO: 481) |
| GCUUGAACUCUGUGCCAAAC; | (SEQ ID NO: 461) |
| GCUUUUGACAGUUUUUAAGG; | (SEQ ID NO: 482) |
| GCUUUUGUUCCUUGGAA; | (SEQ ID NO: 483) |
| GGAACAAAAGCCAGGGACCA; | (SEQ ID NO: 484) |
| GGACUUGACUUUUACCCUUC; | (SEQ ID NO: 485) |
| GGAGAAUAGUUUGUUCU; | (SEQ ID NO: 486) |
| GGAGUCACAUGGGAGUCACA; | (SEQ ID NO: 487) |
| GGAUAGGACAGAGGACA; | (SEQ ID NO: 488) |
| GGCUGUAAGAUAACUACAAA; | (SEQ ID NO: 489) |
| GGGAGAAUAGUUUGUUC; | (SEQ ID NO: 490) |
| GGGAGUCACAUGGGAGUCAC; | (SEQ ID NO: 491) |
| GGGCUCUUCCUGGACCA; | (SEQ ID NO: 492) |
| GGGUACAGGGGUAAGAGAAA; | (SEQ ID NO: 493) |
| GGUCCCUGGCUUUUGUUCCU; | (SEQ ID NO: 494) |
| GUAAAGGUUCAUGAGACUAG; | (SEQ ID NO: 495) |
| GUAACAUAAUCACCUCUCUU; | (SEQ ID NO: 496) |
| GUAAGACUGGAGAUAGAGAC; | (SEQ ID NO: 497) |
| GUACAGGGGUAAGAGAA; | (SEQ ID NO: 498) |
| GUAGCUUUUGACAGUUUUUA; | (SEQ ID NO: 499) |
| GUCACAUGGGAGUCACA; | (SEQ ID NO: 500) |
| GUGGAGAGCCACAGUGCAUG; | (SEQ ID NO: 501) |
| GUUACAAUCUGUGAAUA; | (SEQ ID NO: 502) |
| GUUCUGUCCUCAGUAAA; | (SEQ ID NO: 503) |
| GUUGAGUAUCUCCUGUU; | (SEQ ID NO: 459) |
| GUUUAGAAUGAUCAUUCUUG; | (SEQ ID NO: 504) |
| GUUUGUUCUGGGUACAG; | (SEQ ID NO: 505) |
| UAAAAACUGUCAAAAGCUAC; | (SEQ ID NO: 506) |
| UAAAAGGUAUAGAGUUCAAG; | (SEQ ID NO: 507) |
| UAAAUCAUGCAAGUGACCUA; or | (SEQ ID NO: 508) |
| UAAGAUAACUACAAAGGGUC. | (SEQ ID NO: 509) |

In an embodiment, when two or more gRNAs are used to position two or more breaks, e.g., two or more single stranded breaks in the target nucleic acid sequence, each guide RNA is independently selected from one of Tables 7A-7D. In an embodiment, when two or more gRNAs are used to position four breaks, e.g., four single strand breaks in the target nucleic acid sequence, each guide RNA is independently selected from one of Tables 7A-7D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Table 4A-4D. In some embodiments, the targeting domain is selected from those in Table 4A-4D. For example, in certain embodiments, the targeting domain is:

| | |
|---|---|
| GAAUCCUGAAAGCUACU. | (SEQ ID NO: 510) |

In an embodiment, when two or more gRNAs are used to position two or more breaks, e.g., two or more single stranded breaks in the target nucleic acid sequence, each guide RNA is independently selected from one of Tables 4A-4D. In an embodiment, when two or more gRNAs are used to position four breaks, e.g., four single strand breaks in the target nucleic acid sequence, each guide RNA is independently selected from one of Tables 4A-4D.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 8A-8E. In some embodiments, the targeting domain is selected from those in Tables 8A-8E. For example, in certain embodiments, the targeting domain is:

| | |
|---|---|
| GCUAAAUCAUGCAAGUGACCUAAG; | (SEQ ID NO: 511) |
| GGUCACUUGCAUGAUUUAG; | (SEQ ID NO: 512) |
| GUCACUUGCAUGAUUUAG; | (SEQ ID NO: 513) |
| GCCUAGGACUUUCUAAUGCUGGA; | (SEQ ID NO: 514) |
| GGACUUUCUAAUGCUGGA; | (SEQ ID NO: 515) |
| GGGACCAUGGGAGAAUAGUUUGUU; | (SEQ ID NO: 516) |
| GGACCAUGGGAGAAUAGUUUGUU; | (SEQ ID NO: 517) |
| GACCAUGGGAGAAUAGUUUGUU; | (SEQ ID NO: 518) |
| GGUCCUGGCUUUUGUUCCUUGGA; | (SEQ ID NO: 519) |
| GUCCCUGGCUUUUGUUCCUUGGA; | (SEQ ID NO: 520) |
| GAAAACGUUGUUCUGAGUAGCUUU; | (SEQ ID NO: 521) |
| GUUGUUCUGAGUAGCUUU; | (SEQ ID NO: 522) |
| GGUCCCUGGCUUUUGUUCCU; | (SEQ ID NO: 494) |
| GUCCCUGGCUUUUGUUCCU; | (SEQ ID NO: 523) |
| GACAUCUUGUGGAUAAUGUAUCA; | (SEQ ID NO: 524) |
| GUCCUAGGCAAGAGACAUCUU; | (SEQ ID NO: 525) |
| GCCAGCAAAAGCUUUUGAGCUAA; | (SEQ ID NO: 526) |
| GCAAAAGCUUUUGAGCUAA; | (SEQ ID NO: 527) |
| GAUCUUAUUCUACUCCUGUGA; | (SEQ ID NO: 528) |
| GCUUUCAGGAUUCCUACUAAAUU; | (SEQ ID NO: 529) |
| GUUCUGUCCUCAGUAAAAGGUA; | (SEQ ID NO: 530) |
| GAACAACGUUUUCAUUUA; | (SEQ ID NO: 531) |
| GUAGAAUAUCAUAAGUUACAAUCU; | (SEQ ID NO: 532) |
| GAAUAUCAUAAGUUACAAUCU; | (SEQ ID NO: 533) |
| GUGGCUGUAAGAUAACUACA; | (SEQ ID NO: 534) |
| GGCUGUAAGAUAACUACA; | (SEQ ID NO: 535) |
| GUUUAACGUUAUCAUUUUCCCA; | (SEQ ID NO: 536) |
| GUAAGAGAAAGGGAUGGGCACUUA; | (SEQ ID NO: 537) |
| GAGAAAGGGAUGGGCACUUA; | (SEQ ID NO: 538) |
| GAAAGGGAUGGGCACUUA; | (SEQ ID NO: 539) |
| GUAAAUGAAACGUUGUU; | (SEQ ID NO: 540) |
| GAUAAACAUGACUCAUAAUUUAGU; | (SEQ ID NO: 541) |
| GGAACAAAGCCAGGGACCAUGG; | (SEQ ID NO: 542) |
| GAACAAAGCCAGGGACCAUGG; | (SEQ ID NO: 543) |
| GGGAGAAUAGUUUGUUCUGGGUAC; | (SEQ ID NO: 544) |
| GGAGAAUAGUUUGUUCUGGGUAC; | (SEQ ID NO: 545) |
| GAGAAUAGUUUGUUCUGGGUAC; | (SEQ ID NO: 546) |
| GAAUAGUUUGUUCUGGGUAC; | (SEQ ID NO: 468) |
| GAAAUAGAGGCUUAUGGAUU; | (SEQ ID NO: 547) |
| GUUCUGGGUACAGGGGUAAGAGAA; | (SEQ ID NO: 548) |
| GGGUACAGGGGUAAGAGAA; | (SEQ ID NO: 549) |
| GGUACAGGGGUAAGAGAA; | (SEQ ID NO: 550) |
| GUAAAUUCUCAUCAUUUUUUAUUG; | (SEQ ID NO: 551) |
| GGAGAGGAUAGGACAGAGGACAUG; | (SEQ ID NO: 552) |
| GAGAGGAUAGGACAGAGGACAUG; | (SEQ ID NO: 543) |
| GAGGAUAGGACAGAGGACAUG; | (SEQ ID NO: 554) |
| GGAUAGGACAGAGGACAUG; | (SEQ ID NO: 555) |
| GAUAGGACAGAGGACAUG; | (SEQ ID NO: 556) |
| GAAUAAAUGUAGAAUUUUAAUG; | (SEQ ID NO: 557) |
| GUCAAAGCUACCGGUUACCUG; | (SEQ ID NO: 558) |
| GUUUUUAAGGCGGGGAGUCACAU; | (SEQ ID NO: 559) |
| GUCUUACAUCCUCCUUACUGCCAC; | (SEQ ID NO: 560) |
| GAGUCACAGGGUAGGAUUCAUGUU; | (SEQ ID NO: 561) |
| GUCACAGGGUAGGAUUCAUGUU; | (SEQ ID NO: 562) |
| GGCACAGAGUUCAAGCUAAUACAU; | (SEQ ID NO: 563) |
| GCACAGAGUUCAAGCUAAUACAU; | (SEQ ID NO: 564) |
| GAGUUCAAGCUAAUACAU; | (SEQ ID NO: 565) |
| GAUGCAGAACUAGUGUAGAC; | (SEQ ID NO: 460) |
| GUGUUGAGUAUCUCCUGUUUGGCA; | (SEQ ID NO: 566) |
| GUUGAGUAUCUCCUGUUUGGCA; | (SEQ ID NO: 567) |
| GAGUAUCUCCUGUUUGGCA; | (SEQ ID NO: 568) |
| GAAAAUCAGAUUUCAUGUGUG; | (SEQ ID NO: 569) |
| GCCACAAGAAUGAUCAUUCUAAAC; | (SEQ ID NO: 570) |
| GGCGGGGAGUCACAUGGGAGUCA; | (SEQ ID NO: 571) |
| GCGGGGAGUCACAUGGGAGUCA; | (SEQ ID NO: 572) |
| GGGGAGUCACAUGGGAGUCA; | (SEQ ID NO: 573) |
| GGGAGUCACAUGGGAGUCA; | (SEQ ID NO: 574) |
| GGAGUCACAUGGGAGUCA; | (SEQ ID NO: 575) |
| GCUUUUGACAGUUUUUAAGGCG; | (SEQ ID NO: 576) |
| GAUCAUUCUUGUGGCAGUAAG; | (SEQ ID NO: 577) |
| GAGCAAGAGAUGAACUAG; | (SEQ ID NO: 578) |
| GCCUGAACAAGUUUUGAAAC; | (SEQ ID NO: 480) |
| GUAGAUUGAGGUAGAAUCAAGAA; | (SEQ ID NO: 579) |
| GAUUGAGGUAGAAUCAAGAA; | (SEQ ID NO: 580) |
| GGAUGUAAGACUGGAGAUAGAGAC; | (SEQ ID NO: 581) |
| GAUGUAAGACUGGAGAUAGAGAC; | (SEQ ID NO: 582) |
| GUAAGACUGGAGAUAGAGAC; | (SEQ ID NO: 497) |
| GGGAGUCACAUGGGAGUCACAGGG; | (SEQ ID NO: 583) |
| GGAGUCACAUGGGAGUCACAGGG; | (SEQ ID NO: 584) |

```
GAGUCACAUGGGAGUCACAGGG;        (SEQ ID NO: 585)

GUCACAUGGGAGUCACAGGG;          (SEQ ID NO: 586)

GUUUACAUAUCUGUCUUCCUUAA;       (SEQ ID NO: 587)
or

GAUUUCAUGUGUGAAGAA.            (SEQ ID NO: 588)
```

In an embodiment, when two or more gRNAs are used to position two or more breaks, e.g., two or more single stranded breaks in the target nucleic acid sequence, each guide RNA is independently selected from one of Tables 8A-8E. In an embodiment, when two or more gRNAs are used to position four breaks, e.g., four single strand breaks in the target nucleic acid sequence, each guide RNA is independently selected from one of Tables 8A-8E.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 5A-5B. In some embodiments, the targeting domain is selected from those in Tables 5A-5B. For example, in certain embodiments, the targeting domain is:

```
GAGUUCAAGCUAAUACAUGA;          (SEQ ID NO: 589)

GUUGUUCUGAGUAGCUU;             (SEQ ID NO: 590)

GGCAAAAGCAGCAGAAAGCA;          (SEQ ID NO: 591)

GUUGUUCUGAGUAGCUU;             (SEQ ID NO: 590)
or

GGCAAAAGCAGCAGAAAGCA.          (SEQ ID NO: 591)
```

In an embodiment, when two or more gRNAs are used to position two or more breaks, e.g., two or more single stranded breaks in the target nucleic acid sequence, each guide RNA is independently selected from one of Tables 5A-5B. In an embodiment, when two or more gRNAs are used to position four breaks, e.g., four single strand breaks in the target nucleic acid sequence, each guide RNA is independently selected from one of Tables 5A-5B.

In an embodiment, the LCA10 target position in the CEP290 gene is targeted. In an embodiment, the targeting domain comprises a sequence that is the same as, or differs by no more than 1, 2, 3, 4, or 5 nucleotides from, a targeting domain sequence from Tables 9A-9B. In some embodiments, the targeting domain is selected from those in Tables 9A-9B. For example, in certain embodiments, the targeting domain is:

```
GGCAAAAGCAGCAGAAAGCA;          (SEQ ID NO: 591)

GUGGCUGAAUGACUUCU;             (SEQ ID NO: 592)

UUGUUCUGAGUAGCUU;              (SEQ ID NO: 590)

GACUAGAGGUCACGAAA;             (SEQ ID NO: 593)
or

GAGUUCAAGCUAAUACAUGA.          (SEQ ID NO: 589)
```

In an embodiment, when two or more gRNAs are used to position two or more breaks, e.g., two or more single stranded breaks in the target nucleic acid sequence, each guide RNA is independently selected from one of Tables 9A-9B. In an embodiment, when two or more gRNAs are used to position four breaks, e.g., four single strand breaks in the target nucleic acid sequence, each guide RNA is independently selected from one of Tables 9A-9B.

In an embodiment, the gRNA, e.g., a gRNA comprising a targeting domain, which is complementary with a target domain from the CEP290 gene, is a modular gRNA. In other embodiments, the gRNA is a chimeric gRNA.

In an embodiment, when two gRNAs are used to position two breaks, e.g., two single strand breaks, in the target nucleic acid sequence, each guide RNA is independently selected from one or more of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10.

In an embodiment, the targeting domain which is complementary with a target domain from the CEP290 gene comprises 16 or more nucleotides in length. In an embodiment, the targeting domain which is complementary with a target domain from the CEP290 gene is 16 nucleotides or more in length. In an embodiment, the targeting domain is 16 nucleotides in length. In an embodiment, the targeting domain is 17 nucleotides in length. In an embodiment, the targeting domain is 18 nucleotides in length. In an embodiment, the targeting domain is 19 nucleotides in length. In an embodiment, the targeting domain is 20 nucleotides in length. In an embodiment, the targeting domain is 21 nucleotides in length. In an embodiment, the targeting domain is 22 nucleotides in length. In an embodiment, the targeting domain is 23 nucleotides in length. In an embodiment, the targeting domain is 24 nucleotides in length. In an embodiment, the targeting domain is 25 nucleotides in length. In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

A gRNA as described herein may comprise from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a gRNA comprises a linking domain of no more than 25 nucleotides in length; a proximal and tail domain, that taken together, are at least 20 nucleotides in length; and a targeting domain of equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 40 nucleotides in length; and a targeting domain of equal to or greater than 16, 17, 18, 19, 20, 21, 22, 23, 24, 25 or 26 nucleotides in length.

A cleavage event, e.g., a double strand or single strand break, is generated by a Cas9 molecule. The Cas9 molecule may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule).

In an embodiment, the eaCas9 molecule catalyzes a double strand break.

In some embodiments, the eaCas9 molecule comprises HNH-like domain cleavage activity but has no, or no significant, N-terminal RuvC-like domain cleavage activity. In this case, the eaCas9 molecule is an HNH-like domain nickase, e.g., the eaCas9 molecule comprises a mutation at D10, e.g., D10A. In other embodiments, the eaCas9 molecule comprises N-terminal RuvC-like domain cleavage activity but has no, or no significant, HNH-like domain cleavage activity. In an embodiment, the eaCas9 molecule is an N-terminal RuvC-like domain nickase, e.g., the eaCas9 molecule comprises a mutation at H840, e.g., H840A. In an embodiment, the eaCas9 molecule is an N-terminal RuvC-like domain nickase, e.g., the eaCas9 molecule comprises a mutation at H863, e.g., H863A.

In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

In another aspect, disclosed herein is a nucleic acid, e.g., an isolated or non-naturally occurring nucleic acid, e.g., DNA, that comprises (a) a sequence that encodes a gRNA molecule comprising a targeting domain that is complementary with a target domain in CEP290 gene as disclosed herein.

In an embodiment, the nucleic acid encodes a gRNA molecule, e.g., the first gRNA molecule, comprising a targeting domain comprising a sequence that is the same as, or differs by no more than 1, 2, 3, 4, or 5 nucleotides from, a targeting domain sequence from any one of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. In an embodiment, the nucleic acid encodes a gRNA molecule comprising a targeting domain that is selected from those in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10.

In an embodiment, the nucleic acid encodes a modular gRNA, e.g., one or more nucleic acids encode a modular gRNA. In other embodiments, the nucleic acid encodes a chimeric gRNA. The nucleic acid may encode a gRNA, e.g., the first gRNA molecule, comprising a targeting domain comprising 16 nucleotides or more in length. In one embodiment, the nucleic acid encodes a gRNA, e.g., the first gRNA molecule, comprising a targeting domain that is 16 nucleotides in length. In other embodiments, the nucleic acid encodes a gRNA, e.g., the first gRNA molecule, comprising a targeting domain that is 17 nucleotides in length. In still other embodiments, the nucleic acid encodes a gRNA, e.g., the first gRNA molecule, comprising a targeting domain that is 18 nucleotides in length. In still other embodiments, the nucleic acid encodes a gRNA, e.g., the first gRNA molecule, comprising a targeting domain that is 19 nucleotides in length. In still other embodiments, the nucleic acid encodes a gRNA, e.g., the first gRNA molecule, comprising a targeting domain that is 20 nucleotides in length. In still other embodiments, the nucleic acid encodes a gRNA, e.g., the first gRNA molecule, comprising a targeting domain that is 21 nucleotides in length. In still other embodiments, the nucleic acid encodes a gRNA, e.g., the first gRNA molecule, comprising a targeting domain that is 22 nucleotides in length. In still other embodiments, the nucleic acid encodes a gRNA, e.g., the first gRNA molecule, comprising a targeting domain that is 23 nucleotides in length. In still other embodiments, the nucleic acid encodes a gRNA, e.g., the first gRNA molecule, comprising a targeting domain that is 24 nucleotides in length. In still other embodiments, the nucleic acid encodes a gRNA, e.g., the first gRNA molecule, comprising a targeting domain that is 25 nucleotides in length. In still other embodiments, the nucleic acid encodes a gRNA, e.g., the first gRNA molecule, comprising a targeting domain that is 26 nucleotides in length.

In an embodiment, a nucleic acid encodes a gRNA comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a gRNA e.g., the first gRNA molecule, comprising a linking domain of no more than 25 nucleotides in length; a proximal and tail domain, that taken together, are at least 20 nucleotides in length; and a targeting domain of equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In an embodiment, a nucleic acid encodes a gRNA comprising e.g., the first gRNA molecule, a linking domain of no more than 25 nucleotides in length; a proximal and tail domain, that taken together, are at least 40 nucleotides in length; and a targeting domain of equal to or greater than 16, 17, 18, 19, 20, 21, 22, 23, 24, 25 or 26 nucleotides in length.

In an embodiment, a nucleic acid comprises (a) a sequence that encodes a gRNA molecule comprising a targeting domain that is complementary with a target domain in the CEP290 gene as disclosed herein, and further comprising (b) a sequence that encodes a Cas9 molecule.

The Cas9 molecule may be a nickase molecule, a enzymatically activating Cas9 (eaCas9) molecule, e.g., an eaCas9 molecule that forms a double strand break in a target nucleic acid and an eaCas9 molecule forms a single strand break in a target nucleic acid. In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

In an embodiment, the eaCas9 molecule catalyzes a double strand break.

In some embodiments, the eaCas9 molecule comprises HNH-like domain cleavage activity but has no, or no significant, N-terminal RuvC-like domain cleavage activity. In other embodiments, the said eaCas9 molecule is an HNH-like domain nickase, e.g., the eaCas9 molecule comprises a mutation at D10, e.g., D10A. In other embodiments, the eaCas9 molecule comprises N-terminal RuvC-like domain cleavage activity but has no, or no significant, HNH-like domain cleavage activity. In another embodiment, the eaCas9 molecule is an N-terminal RuvC-like domain nickase, e.g., the eaCas9 molecule comprises a mutation at H840, e.g., H840A. In another embodiment, the eaCas9 molecule is an N-terminal RuvC-like domain nickase, e.g., the eaCas9 molecule comprises a mutation at H863, e.g., H863A.

A nucleic acid disclosed herein may comprise (a) a sequence that encodes a gRNA molecule comprising a targeting domain that is complementary with a target domain in the CEP290 gene as disclosed herein; and (b) a sequence that encodes a Cas9 molecule.

A nucleic acid disclosed herein may comprise (a) a sequence that encodes a gRNA molecule comprising a targeting domain that is complementary with a target domain in the CEP290 gene as disclosed herein; (b) a sequence that encodes a Cas9 molecule; and further comprises (c)(i) a sequence that encodes a second gRNA molecule described herein having a targeting domain that is complementary to a second target domain of the CEP290 gene, and optionally, (ii) a sequence that encodes a third gRNA molecule described herein having a targeting domain that is complementary to a third target domain of the CEP290 gene; and optionally, (iii) a sequence that encodes a fourth gRNA molecule described herein having a targeting domain that is complementary to a fourth target domain of the CEP290 gene.

In an embodiment, a nucleic acid encodes a second gRNA molecule comprising a targeting domain configured to provide a cleavage event, e.g., a double strand break or a single strand break, sufficiently close to a LCA10 target position in the CEP290 gene to allow alteration, e.g., alteration associated with NHEJ, of the LCA10 target position, either alone or in combination with the break positioned by said first gRNA molecule.

In an embodiment, a nucleic acid encodes a third gRNA molecule comprising a targeting domain configured to provide a cleavage event, e.g., a double strand break or a single strand break, sufficiently close to a LCA10 target position in the CEP290 gene to allow alteration, e.g., alteration associated with NHEJ, either alone or in combination with the break positioned by the first and/or second gRNA molecule.

In an embodiment, a nucleic acid encodes a fourth gRNA molecule comprising a targeting domain configured to provide a cleavage event, e.g., a double strand break or a single strand break, sufficiently close to a LCA10 target position in the CEP290 gene to allow alteration, e.g., alteration associated with NHEJ, either alone or in combination with the break positioned by the first gRNA molecule, the second gRNA molecule and/or the third gRNA molecule.

In an embodiment, a nucleic acid encodes a second gRNA molecule comprising a targeting domain configured to provide a cleavage event, e.g., a double strand break or a single strand break, in combination with the break position by said first gRNA molecule, sufficiently close to a LCA10 target position in the CEP290 gene to allow alteration, e.g., alteration associated with NHEJ, of the a LCA10 target position in the CEP290 gene, either alone or in combination with the break positioned by said first gRNA molecule.

In an embodiment, a nucleic acid encodes a third gRNA molecule comprising a targeting domain configured to provide a cleavage event, e.g., a double strand break or a single strand break, in combination with the break position by said first and/or second gRNA molecule sufficiently close to a LCA10 target position in the CEP290 gene to allow alteration, e.g., alteration associated with NHEJ, either alone or in combination with the break positioned by the first and/or second gRNA molecule.

In an embodiment, a nucleic acid encodes a fourth gRNA molecule comprising a targeting domain configured to provide a cleavage event, e.g., a double strand break or a single strand break, in combination with the break positioned by the first gRNA molecule, the second gRNA molecule and/or the third gRNA molecule, sufficiently close to a LCA10 target position in the CEP290 gene to allow alteration, e.g., alteration associated with NHEJ, either alone or in combination with the break positioned by the first gRNA molecule, the second gRNA molecule and/or the third gRNA molecule.

In an embodiment, the nucleic acid encodes a second gRNA molecule. The second gRNA is selected to target the LCA10 target position. Optionally, the nucleic acid may encode a third gRNA, and further optionally, the nucleic acid may encode a fourth gRNA molecule.

In an embodiment, the nucleic acid encodes a second gRNA molecule comprising a targeting domain comprising a sequence that is the same as, or differs by no more than 1, 2, 3, 4, or 5 nucleotides from, a targeting domain sequence from one of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. In an embodiment, the nucleic acid encodes a second gRNA molecule comprising a targeting domain selected from those in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. In an embodiment, when a third or fourth gRNA molecule are present, the third and fourth gRNA molecules may independently comprise a targeting domain comprising a sequence that is the same as, or differs by no more than 1, 2, 3, 4, or 5 nucleotides from, a targeting domain sequence from one of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. In a further embodiment, when a third or fourth gRNA molecule are present, the third and fourth gRNA molecules may independently comprise a targeting domain selected from those in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10.

In an embodiment, the nucleic acid encodes a second gRNA which is a modular gRNA, e.g., wherein one or more nucleic acid molecules encode a modular gRNA. In other embodiments, the nucleic acid encoding a second gRNA is a chimeric gRNA. In other embodiments, when a nucleic acid encodes a third or fourth gRNA, the third and fourth gRNA may be a modular gRNA or a chimeric gRNA. When multiple gRNAs are used, any combination of modular or chimeric gRNAs may be used.

A nucleic acid may encode a second, a third, and/or a fourth gRNA, each independently, comprising a targeting domain comprising 16 nucleotides or more in length. In an embodiment, the nucleic acid encodes a second gRNA comprising a targeting domain that is 16 nucleotides in length. In other embodiments, the nucleic acid encodes a second gRNA comprising a targeting domain that is 17 nucleotides in length. In still other embodiments, the nucleic acid encodes a second gRNA comprising a targeting domain that is 18 nucleotides in length. In still other embodiments, the nucleic acid encodes a second gRNA comprising a targeting domain that is 19 nucleotides in length. In still other embodiments, the nucleic acid encodes a second gRNA comprising a targeting domain that is 20 nucleotides in length. In still other embodiments, the nucleic acid encodes a second gRNA comprising a targeting domain that is 21 nucleotides in length. In still other embodiments, the nucleic acid encodes a second gRNA comprising a targeting domain that is 22 nucleotides in length. In still other embodiments, the nucleic acid encodes a second gRNA comprising a targeting domain that is 23 nucleotides in length. In still other embodiments, the nucleic acid encodes a second gRNA comprising a targeting domain that is 24 nucleotides in length. In still other embodiments, the nucleic acid encodes a second gRNA comprising a targeting domain that is 25 nucleotides in length. In still other embodiments, the nucleic acid encodes a second gRNA comprising a targeting domain that is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, a nucleic acid encodes a second, a third, and/or a fourth gRNA, each independently, comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a second, a third, and/or a fourth gRNA, each independently, comprising a linking domain of no more than 25 nucleotides in length; a proximal and tail domain, that taken together, are at least 20 nucleotides in length; and a targeting domain of equal to or greater than 16, 17, 18, 19, 20, 21, 22, 23, 24, 25 or 26 nucleotides in length.

In an embodiment, a nucleic acid encodes a second, a third, and/or a fourth gRNA, each independently, comprising a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In an embodiment, a nucleic acid encodes a second, a third, and/or a fourth gRNA, each independently, comprising a linking domain of no more than 25 nucleotides in length; a proximal and tail domain, that taken together, are at least 30 nucleotides in length; and a targeting domain of equal to or greater than 16, 17, 18, 19, 20, 21, 22, 23, 24, 25 or 26 nucleotides in length.

In an embodiment, a nucleic acid encodes a second, a third, and/or a fourth gRNA, each independently, comprising a linking domain of no more than 25 nucleotides in length; a proximal and tail domain, that taken together, are at least 40 nucleotides in length; and a targeting domain of equal to or greater than 16, 17, 18, 19, 20, 21, 22, 23, 24, 25 or 26 nucleotides in length.

In some embodiments, when the CEP290 gene is altered, e.g., by NHEJ, the nucleic acid encodes (a) a sequence that encodes a gRNA molecule comprising a targeting domain that is complementary with a target domain in the CEP290 gene as disclosed herein; (b) a sequence that encodes a Cas9 molecule; optionally, (c)(i) a sequence that encodes a second gRNA molecule described herein having a targeting domain that is complementary to a second target domain of the CEP290 gene, and further optionally, (ii) a sequence that encodes a third gRNA molecule described herein having a targeting domain that is complementary to a third target domain of the CEP290 gene; and still further optionally, (iii) a sequence that encodes a fourth gRNA molecule described herein having a targeting domain that is complementary to a fourth target domain of the CEP290 gene.

As described above, a nucleic acid may comprise (a) a sequence encoding a gRNA molecule comprising a targeting domain that is complementary with a target domain in the CEP290, and (b) a sequence encoding a Cas9 molecule. In some embodiments, (a) and (b) are present on the same nucleic acid molecule, e.g., the same vector, e.g., the same viral vector, e.g., the same adeno-associated virus (AAV) vector. In an embodiment, the nucleic acid molecule is an AAV vector, e.g., an AAV vector described herein. Exemplary AAV vectors that may be used in any of the described compositions and methods include an AAV1 vector, a modified AAV1 vector, an AAV2 vector, a modified AAV2 vector, an AAV3 vector, a modified AAV3 vector, an AAV4 vector, a modified AAV4 vector, an AAV5 vector, a modified AAV5 vector, an AAV6 vector, a modified AAV6 vector, an AAV7 vector, a modified AAV7 vector, an AAV8 vector, an AAV9 vector, an AAV.rh10 vector, a modified AAV.rh10 vector, an AAV.rh32/33 vector, a modified AAV.rh32/33 vector, an AAV.rh43 vector, a modified AAV.rh43 vector, an AAV.rh64R1 vector, and a modified AAV.rh64R1 vector.

In other embodiments, (a) is present on a first nucleic acid molecule, e.g. a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors, e.g., the AAV vectors described herein.

In other embodiments, the nucleic acid may further comprise (c)(i) a sequence that encodes a second gRNA molecule as described herein. In some embodiments, the nucleic acid comprises (a), (b) and (c)(i). Each of (a) and (c)(i) may be present on the same nucleic acid molecule, e.g., the same vector, e.g., the same viral vector, e.g., the same adeno-associated virus (AAV) vector. In an embodiment, the nucleic acid molecule is an AAV vector, e.g., an AAV vectors described herein.

In other embodiments, (a) and (c)(i) are on different vectors. For example, (a) may be present on a first nucleic acid molecule, e.g. a first vector, e.g., a first viral vector, e.g., a first AAV vector; and (c)(i) may be present on a second nucleic acid molecule, e.g., a second vector, e.g., a second vector, e.g., a second AAV vector. In an embodiment, the first and second nucleic acid molecules are AAV vectors, e.g., the AAV vectors described herein.

In another embodiment, each of (a), (b), and (c)(i) are present on the same nucleic acid molecule, e.g., the same vector, e.g., the same viral vector, e.g., an AAV vector. In an embodiment, the nucleic acid molecule is an AAV vector. In an alternate embodiment, one of (a), (b), and (c)(i) is encoded on a first nucleic acid molecule, e.g., a first vector, e.g., a first viral vector, e.g., a first AAV vector; and a second and third of (a), (b), and (c)(i) is encoded on a second nucleic acid molecule, e.g., a second vector, e.g., a second vector, e.g., a second AAV vector. The first and second nucleic acid molecule may be AAV vectors, e.g., the AAV vectors described herein.

In an embodiment, (a) is present on a first nucleic acid molecule, e.g., a first vector, e.g., a first viral vector, a first AAV vector; and (b) and (c)(i) are present on a second nucleic acid molecule, e.g., a second vector, e.g., a second vector, e.g., a second AAV vector. The first and second nucleic acid molecule may be AAV vectors, e.g., the AAV vectors described herein.

In other embodiments, (b) is present on a first nucleic acid molecule, e.g., a first vector, e.g., a first viral vector, e.g., a first AAV vector; and (a) and (c)(i) are present on a second nucleic acid molecule, e.g., a second vector, e.g., a second vector, e.g., a second AAV vector. The first and second nucleic acid molecule may be AAV vectors, e.g., the AAV vectors described herein.

In other embodiments, (c)(i) is present on a first nucleic acid molecule, e.g., a first vector, e.g., a first viral vector, e.g., a first AAV vector; and (b) and (a) are present on a second nucleic acid molecule, e.g., a second vector, e.g., a second vector, e.g., a second AAV vector. The first and second nucleic acid molecule may be AAV vectors, e.g., the AAV vectors described herein.

In another embodiment, each of (a), (b) and (c)(i) are present on different nucleic acid molecules, e.g., different vectors, e.g., different viral vectors, e.g., different AAV vector. For example, (a) may be on a first nucleic acid molecule, (b) on a second nucleic acid molecule, and (c)(i) on a third nucleic acid molecule. The first, second and third nucleic acid molecule may be AAV vectors, e.g., the AAV vectors described herein.

In another embodiment, when a third and/or fourth gRNA molecule are present, each of (a), (b), (c)(i), (c) (ii) and (c)(iii) may be present on the same nucleic acid molecule, e.g., the same vector, e.g., the same viral vector, e.g., an AAV vector. In an embodiment, the nucleic acid molecule is an AAV vector, e.g., an AAV vector. In an alternate embodiment, each of (a), (b), (c)(i), (c)(ii) and (c)(iii) may be present on the different nucleic acid molecules, e.g., different vectors, e.g., the different viral vectors, e.g., different AAV vectors. In further embodiments, each of (a), (b), (c)(i), (c) (ii) and (c)(iii) may be present on more than one nucleic acid molecule, but fewer than five nucleic acid molecules, e.g., AAV vectors, e.g., the AAV vectors described herein.

The nucleic acids described herein may comprise a promoter operably linked to the sequence that encodes the gRNA molecule of (a), e.g., a promoter described herein, e.g., a promoter described in Table 19. The nucleic acid may further comprise a second promoter operably linked to the sequence that encodes the second, third and/or fourth gRNA molecule of (c), e.g., a promoter described herein. The promoter and second promoter differ from one another. In some embodiments, the promoter and second promoter are the same.

The nucleic acids described herein may further comprise a promoter operably linked to the sequence that encodes the Cas9 molecule of (b), e.g., a promoter described herein, e.g., a promoter described in Table 19.

In another aspect, disclosed herein is a composition comprising (a) a gRNA molecule comprising a targeting domain that is complementary with a target domain in the CEP290 gene, as described herein. The composition of (a) may further comprise (b) a Cas9 molecule, e.g., a Cas9 molecule as described herein. A composition of (a) and (b) may further comprise (c) a second, third and/or fourth gRNA molecule, e.g., a second, third and/or fourth gRNA molecule described herein.

In another aspect, methods and compositions discussed herein, provide for treating or delaying the onset or progression of LCA10 by altering the LCA10 target position in the CEP290 gene.

In another aspect, disclosed herein is a method of altering a cell, e.g., altering the structure, e.g., altering the sequence, of a target nucleic acid of a cell, comprising contacting said cell with: (a) a gRNA that targets the CEP290 gene, e.g., a gRNA as described herein; (b) a Cas9 molecule, e.g., a Cas9 molecule as described herein; and optionally, (c) a second, third and/or fourth gRNA that targets CEP290 gene, e.g., a gRNA as described herein.

In some embodiments, the method comprises contacting said cell with (a) and (b).

In some embodiments, the method comprises contacting said cell with (a), (b), and (c).

The gRNA of (a) may be selected from any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, or a gRNA that differs by no more than 1, 2, 3, 4, or 5 nucleotides from, a targeting domain sequence from any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. The gRNA of (c) may be selected from any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, or a gRNA that differs by no more than 1, 2, 3, 4, or 5 nucleotides from, a targeting domain sequence from any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10.

In some embodiments, the method comprises contacting a cell from a subject suffering from or likely to develop LCA10. The cell may be from a subject having a mutation at a LCA10 target position.

In some embodiments, the cell being contacted in the disclosed method is a photoreceptor cell. The contacting may be performed ex vivo and the contacted cell may be returned to the subject's body after the contacting step. In other embodiments, the contacting step may be performed in vivo.

In some embodiments, the method of altering a cell as described herein comprises acquiring knowledge of the presence of a LCA10 target position in said cell, prior to the contacting step. Acquiring knowledge of the presence of a LCA10 target position in the cell may be by sequencing the CEP290 gene, or a portion of the CEP290 gene.

In some embodiments, the contacting step of the method comprises contacting the cell with a nucleic acid, e.g., a vector, e.g., an AAV vector, e.g., an AAV vector described herein, that expresses at least one of (a), (b), and (c). In some embodiments, the contacting step of the method comprises contacting the cell with a nucleic acid, e.g., a vector, e.g., an AAV vector, that expresses each of (a), (b), and (c). In another embodiment, the contacting step of the method comprises delivering to the cell a Cas9 molecule of (b) and a nucleic acid which encodes a gRNA (a) and optionally, a second gRNA (c)(i) (and further optionally, a third gRNA (c)(iv) and/or fourth gRNA (c)(iii)).

In an embodiment, contacting comprises contacting the cell with a nucleic acid, e.g., a vector, e.g., an AAV vector, e.g., an AAV1 vector, a modified AAV1 vector, an AAV2 vector, a modified AAV2 vector, an AAV3 vector, a modified AAV3 vector, an AAV4 vector, a modified AAV4 vector, an AAV5 vector, a modified AAV5 vector, an AAV6 vector, a modified AAV6 vector, an AAV7 vector, a modified AAV7 vector, an AAV8 vector, an AAV9 vector, an AAV.rh10 vector, a modified AAV.rh10 vector, an AAV.rh32/33 vector, a modified AAV.rh32/33 vector, an AAV.rh43 vector, a modified AAV.rh43 vector, an AAV.rh64R1 vector, and a modified AAV.rh64R1 vector, e.g., an AAV vector described herein.

In an embodiment, contacting comprises delivering to said cell said Cas9 molecule of (b), as a protein or an mRNA, and a nucleic acid which encodes and (a) and optionally (c).

In an embodiment, contacting comprises delivering to said cell said Cas9 molecule of (b), as a protein or an mRNA, said gRNA of (a), as an RNA, and optionally said second gRNA of (c), as an RNA.

In an embodiment, contacting comprises delivering to said cell said gRNA of (a) as an RNA, optionally said second gRNA of (c) as an RNA, and a nucleic acid that encodes the Cas9 molecule of (b).

In another aspect, disclosed herein is a method of treating, or preventing a subject suffering from developing, LCA10, e.g., by altering the structure, e.g., sequence, of a target nucleic acid of the subject, comprising contacting the subject (or a cell from the subject) with:

(a) a gRNA that targets the CEP290 gene, e.g., a gRNA disclosed herein;

(b) a Cas9 molecule, e.g., a Cas9 molecule disclosed herein; and optionally, (c)(i) a second gRNA that targets the CEP290 gene, e.g., a second gRNA disclosed herein, and further optionally, (c)(ii) a third gRNA, and still further optionally, (c)(iii) a fourth gRNA that target the CEP290, e.g., a third and fourth gRNA disclosed herein.

In some embodiments, contacting comprises contacting with (a) and (b).

In some embodiments, contacting comprises contacting with (a), (b), and (c)(i).

In some embodiments, contacting comprises contacting with (a), (b), (c)(i) and (c)(ii).

In some embodiments, contacting comprises contacting with (a), (b), (c)(i), (c)(ii) and (c)(iii).

The gRNA of (a) or (c) (e.g., (c)(i), (c)(ii), or (c)(iii)) may be independently selected from any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, or a gRNA that differs by no more than 1, 2, 3, 4, or 5 nucleotides from, a targeting domain sequence from any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10.

In an embodiment, said subject is suffering from, or likely to develop LCA10. In an embodiment, said subject has a mutation at a LCA10 target position.

In an embodiment, the method comprises acquiring knowledge of the presence of a mutation at a LCA10 target position in said subject.

In an embodiment, the method comprises acquiring knowledge of the presence of a mutation a LCA10 target position in said subject by sequencing the CEP290 gene or a portion of the CEP290 gene.

In an embodiment, the method comprises altering the LCA10 target position in the CEP290 gene.

In an embodiment, a cell of said subject is contacted ex vivo with (a), (b) and optionally (c). In an embodiment, said cell is returned to the subject's body.

In an embodiment, the method comprises introducing a cell into said subject's body, wherein said cell subject was contacted ex vivo with (a), (b) and optionally (c).

In an embodiment, the method comprises said contacting is performed in vivo. In an embodiment, the method comprises sub-retinal delivery. In an embodiment, contacting comprises sub-retinal injection. In an embodiment, contacting comprises intra-vitreal injection.

In an embodiment, contacting comprises contacting the subject with a nucleic acid, e.g., a vector, e.g., an AAV vector described herein, e.g., a nucleic acid that encodes at least one of (a), (b), and optionally (c).

In an embodiment, contacting comprises delivering to said subject said Cas9 molecule of (b), as a protein or mRNA, and a nucleic acid which encodes and (a) and optionally (c).

In an embodiment, contacting comprises delivering to said subject said Cas9 molecule of (b), as a protein or mRNA, said gRNA of (a), as an RNA, and optionally said second gRNA of (c), as an RNA.

In an embodiment, contacting comprises delivering to said subject said gRNA of (a), as an RNA, optionally said second gRNA of (c), as an RNA, and a nucleic acid that encodes the Cas9 molecule of (b).

In another aspect, disclosed herein is a reaction mixture comprising a gRNA, a nucleic acid, or a composition described herein, and a cell, e.g., a cell from a subject having, or likely to develop LCA10, or a subject having a mutation at a LCA10 target position.

In another aspect, disclosed herein is a kit comprising, (a) a gRNA molecule described herein, or a nucleic acid that encodes said gRNA, and one or more of the following:

(b) a Cas9 molecule, e.g., a Cas9 molecule described herein, or a nucleic acid or mRNA that encodes the Cas9;

(c)(i) a second gRNA molecule, e.g., a second gRNA molecule described herein or a nucleic acid that encodes (c)(i);

(c)(ii) a third gRNA molecule, e.g., a second gRNA molecule described herein or a nucleic acid that encodes (c)(ii); or (c)(iii) a fourth gRNA molecule, e.g., a second gRNA molecule described herein or a nucleic acid that encodes (c)(iii).

In an embodiment, the kit comprises nucleic acid, e.g., an AAV vector, e.g., an AAV vector described herein, that encodes one or more of (a), (b), (c)(i), (c)(ii), and (c)(iii). In an embodiment, the kit further comprises a governing gRNA molecule, or a nucleic acid that encodes a governing gRNA molecule.

In yet another aspect, disclosed herein is a gRNA molecule, e.g., a gRNA molecule described herein, for use in treating LCA10 in a subject, e.g., in accordance with a method of treating LCA10 as described herein.

In an embodiment, the gRNA molecule in used in combination with a Cas9 molecule, e.g., a Cas9 molecule described herein. Additionally or alternatively, in an embodiment, the gRNA molecule is used in combination with a second, third and/or fourth gRNA molecule, e.g., a second, third and/or fourth gRNA molecule described herein.

In still another aspect, disclosed herein is use of a gRNA molecule, e.g., a gRNA molecule described herein, in the manufacture of a medicament for treating LCA10 in a subject, e.g., in accordance with a method of treating LCA10 as described herein.

In an embodiment, the medicament comprises a Cas9 molecule, e.g., a Cas9 molecule described herein. Additionally or alternatively, in an embodiment, the medicament comprises a second, third and/or fourth gRNA molecule, e.g., a second, third and/or fourth gRNA molecule described herein.

In one aspect, disclosed herein is a recombinant adenovirus-associated virus (AAV) genome comprising the following components:

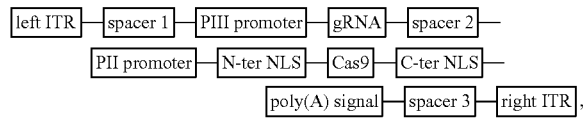

wherein the left ITR component comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, any of the left ITR nucleotide sequences disclosed in Table 24, or any of the nucleotide sequences of SEQ ID NOS: 407-415;

wherein the spacer 1 component comprises, or consists of, a nucleotide sequence having 0 to 150 nucleotides in length, e.g., SEQ ID NO: 416;

wherein the PIII promoter component comprises, or consists of, an RNA polymerase III promoter sequence;

wherein the gRNA component comprises a targeting domain and a scaffold domain, wherein the targeting domain is 16-26 nucleotides in length, and comprises, or consists of, a targeting domain sequence disclosed herein, e.g., in any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10; and wherein the scaffold domain (also referred to as a tracr domain in FIGS. 19A-24F) comprises, or consists of, a nucleotide sequence that is the same as, differs by no more than 1, 2, 3, 4, or 5 nucleotides from, or has at least has at least 90%, 92%, 94%, 96%, 98%, or 99% homology with, a nucleotide sequence of SEQ ID NO: 418;

wherein the spacer 2 component comprises, or consists of, a nucleotide sequence having 0 to 150 nucleotides in length e.g., SEQ ID NO: 419;

wherein the PII promoter component comprises, or consists of, a polymerase II promoter sequence, e.g., a constitutive or tissue specific promoter, e.g., a promoter disclosed in Table 19;

wherein the N-ter NLS component comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 420 or a nucleotide sequence that encodes the amino acid sequence of SEQ ID NO: 434;

wherein the Cas9 component comprises, or consists of, a nucleotide sequence that is the same as, differs by no more than 1, 2, 3, 4, 5, 6, 7, 8, 9, or 10 nucleotides from, or has at least 90%, 92%, 94%, 96%, 98%, or 99% homology with, the nucleotide sequence of SEQ ID NO: 421 or a nucleotide sequence that encodes the amino acid sequence of SEQ ID NO: 435;

wherein the C-ter NLS component comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 422 or a nucleotide sequence that encodes the amino acid sequence of SEQ ID NO: 434;

wherein the poly(A) signal component comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, any of the nucleotide sequences disclosed in Table 26, or any of the nucleotide sequences of SEQ ID NOS: 424, 455 or 456;

wherein the spacer 3 component comprises, or consists of, a nucleotide sequence having 0 to 150 nucleotides in length, e.g., SEQ ID NO: 425; and wherein the right ITR component comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, any of the right ITR nucleotide sequences disclosed in Table 24, or any of the nucleotide sequences of SEQ ID NOS: 436-444.

In an embodiment, the left ITR component comprises, or consists of, a nucleotide sequence that is the same as any of the nucleotide sequences of SEQ ID NOS: 407-415.

In an embodiment, the spacer 1 component comprises, or consists of, a nucleotide sequence that is the same as the nucleotide sequence of SEQ ID NO: 416.

In an embodiment, the PIII promoter component is a U6 promoter component.

In an embodiment, the U6 promoter component comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 417;

In an embodiment, the U6 promoter component comprises, or consists of, a nucleotide sequence that is the same as the nucleotide sequence of SEQ ID NO: 417.

In an embodiment, the PIII promoter component is an H1 promoter component that comprises an H1 promoter sequence.

In an embodiment, the PIII promoter component is a tRNA promoter component that comprises a tRNA promoter sequence.

In an embodiment, the targeting domain comprises, or consists of, a nucleotide sequence that is the same as a nucleotide sequence selected from Table 10.

In an embodiment, the gRNA scaffold domain comprises, or consists of, a nucleotide sequence that is the same as the nucleotide sequence of SEQ ID NO: 418.

In an embodiment, the spacer 2 component comprises, or consists of, a nucleotide sequence that is the same as the nucleotide sequence of SEQ ID NO: 419;

In an embodiment, the PII promoter component is a CMV promoter component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 401. In an embodiment, the PII promoter comprises, or consists of, a nucleotide sequence that is the same as the nucleotide sequence of SEQ ID NO: 401.

In an embodiment, the PII promoter component is an EFS promoter component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 402. In an embodiment, the PII promoter comprises, or consists of, a nucleotide sequence that is the same as the nucleotide sequence of SEQ ID NO: 402.

In an embodiment, the PII promoter component is a GRK1 promoter (e.g., a human GRK1 promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 403. In an embodiment, the PII promoter comprises, or consists of, a nucleotide sequence that is the same as the nucleotide sequence of SEQ ID NO: 403.

In an embodiment, the PII promoter component is a CRX promoter (e.g., a human CRX promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 404. In an embodiment, the PII promoter comprises, or consists of, a nucleotide sequence that is the same as the nucleotide sequence of SEQ ID NO: 404.

In an embodiment, the PII promoter component is an NRL promoter (e.g., a human NRL promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 405. In an embodiment, the PII promoter comprises, or consists of, a nucleotide sequence that is the same as the nucleotide sequence of SEQ ID NO: 405.

In an embodiment, the PII promoter component is an RCVRN promoter (e.g., a human RCVRN promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 406. In an embodiment, the PII promoter comprises, or consists of, a nucleotide sequence that is the same as the nucleotide sequence of SEQ ID NO: 406.

In an embodiment, the N-ter NLS component comprises, or consists of, a nucleotide sequence that is the same as the nucleotide sequence of SEQ ID NO: 420 or a nucleotide sequence encoding the amino acid sequence of SEQ ID NO: 434.

In an embodiment, the Cas9 component comprises, or consists of, a nucleotide sequence that is the same as the nucleotide sequence of SEQ ID NO: 421 or a nucleotide sequence encoding the amino acid sequence of SEQ ID NO: 435.

In an embodiment, the C-ter NLS component comprises, or consists of, a nucleotide sequence that is the same as the nucleotide sequence of SEQ ID NO: 422 or a nucleotide sequence encoding the amino acid sequence of SEQ ID NO: 434.

In an embodiment, the poly(A) signal component comprises, or consists of, a nucleotide sequence that is the same as any of the nucleotide sequences disclosed in Table 26, or any of the nucleotide sequences of SEQ ID NOS: 424, 455 or 456. In an embodiment, the poly(A) signal component comprises, or consists of, a nucleotide sequence that is the same as the nucleotide sequence of SEQ ID NO: 424.

In an embodiment, the spacer 3 component comprises, or consists of, a nucleotide sequence that is the same as the nucleotide sequence of SEQ ID NO: 425.

In an embodiment, the right ITR component comprises, or consists of, a nucleotide sequence that is the same as any of the nucleotide sequences of SEQ ID NOS: 436-444.

In an embodiment, the recombinant AAV genome further comprises a second gRNA component comprising a targeting domain and a scaffold domain, wherein the targeting domain consists of a targeting domain sequence disclosed herein, in any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10; and wherein the scaffold domain (also referred to as a tracr domain in FIGS. 19A-24F) comprises, or consists of, a nucleotide sequence that is the same as, or differs by no more than 1, 2, 3, 4, or 5 nucleotides from, or has at least has at least 90%, 92%, 94%, 96%, 98%, or 99% homology with, the nucleotide sequence of SEQ ID NO: 418.

In an embodiment, the targeting domain of the second gRNA component comprises, or consists of, a nucleotide sequence that is the same as a nucleotide sequence selected from Table 10. In an embodiment, the second gRNA component is between the first gRNA component and the spacer 2 component.

In an embodiment, the second gRNA component has the same nucleotide sequence as the first gRNA component. In another embodiment, the second gRNA component has a nucleotide sequence that is different from the second gRNA component.

In an embodiment, the recombinant AAV genome further comprises a second PIII promoter component that comprises, or consists of, an RNA polymerase III promoter sequence;

In an embodiment, the recombinant AAV genome further comprises a second PIII promoter component (e.g., a second U6 promoter component) between the first gRNA component and the second gRNA component.

In an embodiment, the second PIII promoter component (e.g., the second U6 promoter component) has the same nucleotide sequence as the first PIII promoter component (e.g., the first U6 promoter component). In another embodiment, the second PIII promoter component (e.g., the second U6 promoter component) has a nucleotide sequence that is different from the first PIII promoter component (e.g. the first U6 promoter component).

In an embodiment, the PIII promoter component is an H1 promoter component that comprises an H1 promoter sequence.

In an embodiment, the PIII promoter component is a tRNA promoter component that comprises a tRNA promoter sequence.

In an embodiment, the recombinant AAV genome further comprises a spacer 4 component between the first gRNA component and the second PIII promoter component (e.g., the second U6 promoter component). In an embodiment, the spacer 4 component comprises, or consists of, a nucleotide sequence having 0 to 150 nucleotides in length, e.g., SEQ ID NO: 427. In an embodiment, the spacer 4 component comprises, or consists of, a nucleotide sequence that is the same as the nucleotide sequence of SEQ ID NO: 427.

In an embodiment, the recombinant AAV genome comprises the following components:

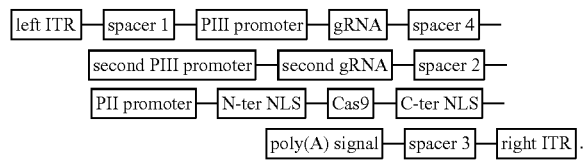

In an embodiment, the recombinant AAV genome further comprises an affinity tag component (e.g., 3×FLAG component), wherein the affinity tag component (e.g., 3×FLAG component) comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotides sequence of SEQ ID NO: 423, or a nucleotide sequence encoding any of the amino acid sequences disclosed in Table 25 or any of the amino acid sequences of SEQ ID NO: 426 or 451-454.

In an embodiment, the affinity tag component (e.g., 3×FLAG component) is between the C-ter NLS component and the poly(A) signal component. In an embodiment, the an affinity tag component (e.g., 3×FLAG component) comprises, or consists of, a nucleotide sequence that is the same as, the nucleotides sequence of SEQ ID NO: 423, or a nucleotide sequence encoding any of the amino acid sequences of SEQ ID NOS: 426 or 451-454.

In an embodiment, the recombinant AAV genome comprises the nucleotide sequences of SEQ ID NOS: 408, 417, 418, 401, 420, 421, 422, 424, and 437.

In an embodiment, the recombinant AAV genome comprises the nucleotide sequences of SEQ ID NOS: 408, 417, 418, 402, 420, 421, 422, 424, and 437.

In an embodiment, the recombinant AAV genome comprises the nucleotide sequences of SEQ ID NOS: 408, 417, 418, 403, 420, 421, 422, 424, and 437.

In an embodiment, the recombinant AAV genome comprises the nucleotide sequences of SEQ ID NOS: 408, 417, 418, 404, 420, 421, 422, 424, and 437.

In an embodiment, the recombinant AAV genome comprises the nucleotide sequences of SEQ ID NOS: 408, 417, 418, 405, 420, 421, 422, 424, and 437.

In an embodiment, the recombinant AAV genome comprises the nucleotide sequences of SEQ ID NOS: 408, 417, 418, 406, 420, 421, 422, 424, and 437.

In an embodiment, the recombinant AAV genome further comprises SEQ ID NOS: 416, 419, and 425, and, optionally, SEQ ID NO 427.

In an embodiment, the recombinant AAV genome further comprises the nucleotide sequence of SEQ ID NO: 423.

In an embodiment, the recombinant AAV genome comprises or consists of one or more (e.g., 2, 3, 4, 5, 6, 7, 8, 9, 10, 11, 12 or all) of the component sequences shown in FIG. 19A-19G, 20A-20F, 21A-21F, 22A-22F, 23A-23F, or 24A-24F, Tables 19 or 24-26, or any of the nucleotide sequences of SEQ ID NOS: 428-433 or 436-444.

In another aspect, disclosed herein is a recombinant adenovirus-associated virus (AAV) genome comprising the following components:

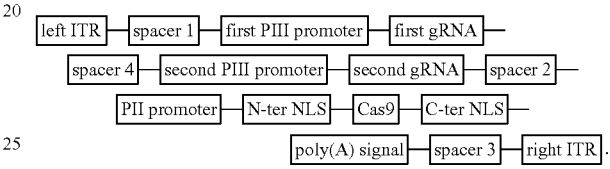

wherein the left ITR component comprises, or consists of, a nucleotide sequence that is the same as, or differs by no more than 1, 2, 3, 4, 5, 6, 7, 8, 9, or 10 nucleotides from, or has at least 90%, 92%, 94%, 96%, 98%, or 99% homology with, any of the left ITR nucleotide sequences disclosed in Table 24, or any of the nucleotide sequences of SEQ ID NOS: 407-415;

wherein the spacer 1 component comprises, or consists of, a nucleotide sequence having 0 to 150 nucleotides in length, e.g., SEQ ID NO: 416;

wherein the first PIII promoter component (e.g., a first U6 promoter component) comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 417;

wherein the first gRNA component comprises a targeting domain and a scaffold domain, wherein the targeting domain is 16-26 nucleotides in length, and comprises, or consists of, a targeting domain sequence disclosed herein, e.g., in any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10; and wherein the scaffold domain (also referred to herein as a tracr domain in FIGS. 19A-24F) comprises, or consists of, a nucleotide sequence that is the same as, or differs by no more than 1, 2, 3, 4, or 5 nucleotides from, or has at least has at least 90%, 92%, 94%, 96%, 98%, or 99% homology with, the nucleotide sequence of SEQ ID NO: 418;

wherein the spacer 4 component comprises, or consists of, a nucleotide sequence having 0 to 150 nucleotides in length, e.g., SEQ ID NO: 427.

wherein the second gRNA component comprises a targeting domain and a scaffold domain, wherein the targeting domain of the second gRNA component is 16-26 nucleotides in length and comprises, or consists of, a targeting domain sequence disclosed herein, e.g., in any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10; and wherein the scaffold domain (also referred to as a tracr domain in FIGS. 19A-24F) of the second gRNA component comprises, or consists of, a nucleotide sequence that is the same as, or differs by no more than 1, 2, 3, 4, or 5 nucleotides from, or has at least has at least 90%, 92%, 94%, 96%, 98%, or 99% homology with, the nucleotide sequence of SEQ ID NO: 418.

wherein the spacer 2 component comprises, or consists of, a nucleotide sequence having 0 to 150 nucleotides in length e.g., SEQ ID NO: 419;

wherein the PII promoter component comprises, or consists of, a polymerase II promoter sequence, e.g., a constitutive or tissue specific promoter, e.g., a promoter disclosed in Table 19;

wherein the N-ter NLS component comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 420 or a nucleotide sequence that encodes the amino acid sequence of SEQ ID NO: 434;

wherein the Cas9 component comprises, or consists of, a nucleotide sequence that is the same as, differs by no more than 1, 2, 3, 4, 5, 6, 7, 8, 9, or 10 nucleotides from, or has at least 90%, 92%, 94%, 96%, 98%, or 99% homology with, the nucleotide sequence of SEQ ID NO: 421 or a nucleotide sequence that encodes the amino acid sequence of SEQ ID NO: 435;

wherein the C-ter NLS component comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 422 or a nucleotide sequence that encodes the amino acid sequence of SEQ ID NO: 434;

wherein the poly(A) signal component comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, any of the nucleotide sequences disclosed in Table 26, or any of the nucleotide sequence of SEQ ID NO: 424, 455 or 456;

wherein the spacer 3 component comprises, or consists of, a nucleotide sequence having 0 to 150 nucleotides in length, e.g., SEQ ID NO: 425; and wherein the right ITR component comprises, or consists of, a nucleotide sequence that is the same as, or differs by no more than 1, 2, 3, 4, 5, 6, 7, 8, 9, or 10 nucleotides from, or has at least has at least 90%, 92%, 94%, 96%, 98%, or 99% homology with, any of the right ITR nucleotide sequences disclosed in Table 24, or SEQ ID NOS: 436-444.

In an embodiment, the left ITR component comprises, or consists of, a nucleotide sequence that is the same as any of the nucleotide sequences of SEQ ID NOS: 407-415.

In an embodiment, the spacer 1 component comprises, or consists of, a nucleotide sequence that is the same as the nucleotide sequence of SEQ ID NO: 416.

In an embodiment, the first PIII promoter component (e.g., the first U6 promoter component) comprises, or consists of, a nucleotide sequence that is the same as the nucleotide sequence of SEQ ID NO: 417.

In an embodiment, the first PIII promoter is an H1 promoter component that comprises an H1 promoter sequence. In another embodiment, the first PIII promoter is a tRNA promoter component that comprises a tRNA promoter sequence.

In an embodiment, the targeting domain of the first gRNA component comprises, or consists of, a nucleotide sequence that is the same as a nucleotide sequence selected from Table 10.

In an embodiment, the gRNA scaffold domain of the first gRNA component comprises, or consists of, a nucleotide sequence that is the same as the nucleotide sequence of SEQ ID NO: 418.

In an embodiment, the spacer 4 component comprises, or consists of, a nucleotide sequence that is the same as the nucleotide sequence of SEQ ID NO: 427.

In an embodiment, the second PIII promoter component (e.g., the first U6 promoter component) has the same nucleotide sequence as the first PIII promoter component (e.g., the first U6 promoter component). In another embodiment, the second PIII promoter component (e.g., the second U6 promoter component) has a nucleotide sequence that is different from the first PIII promoter component (e.g., the first U6 promoter component).

In an embodiment, the second PIII promoter is an H1 promoter component that comprises an H1 promoter sequence. In another embodiment, the second PIII promoter is a tRNA promoter component that comprises a tRNA promoter sequence.

In an embodiment, the targeting domain of the second gRNA component comprises, or consists of, a nucleotide sequence that is the same as a nucleotide sequence selected from Table 10.

In an embodiment, the second gRNA component has the same nucleotide sequence as the first gRNA component. In another embodiment, the second gRNA component has a nucleotide sequence that is different from the second gRNA component.

In an embodiment, the spacer 2 component comprises, or consists of, a nucleotide sequence having 0 to 150 nucleotides in length e.g., SEQ ID NO: 419;

In an embodiment, the PII promoter component is a CMV promoter component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 401. In an embodiment, the PII promoter comprises, or consists of, a nucleotide sequence that is the same as the nucleotide sequence of SEQ ID NO: 401.

In an embodiment, the PII promoter component is an EFS promoter component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 402. In an embodiment, the PII promoter comprises, or consists of, a nucleotide sequence that is the same as the nucleotide sequence of SEQ ID NO: 402.

In an embodiment, the PII promoter component is a GRK1 promoter (e.g., a human GRK1 promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 403. In an embodiment, the PII promoter comprises, or consists of, a nucleotide sequence that is the same as the nucleotide sequence of SEQ ID NO: 403.

In an embodiment, the PII promoter component is a CRX promoter (e.g., a human CRX promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 404. In an embodiment, the PII promoter comprises, or consists of, a nucleotide sequence that is the same as the nucleotide sequence of SEQ ID NO: 404.

In an embodiment, the PII promoter component is an NRL promoter (e.g., a human NRL promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 405. In an embodiment, the PII promoter comprises, or consists of, a nucleotide sequence that is the same as the nucleotide sequence of SEQ ID NO: 405.

In an embodiment, the PII promoter component is an RCVRN promoter (e.g., a human RCVRN promoter) component, and comprises, or consists of, a nucleotide sequence that is the same as, differs by no more than 1, 2, 3, 4, 5, 6, 7, 8, 9, or 10 nucleotides from, or has at least has at least 90%, 92%, 94%, 96%, 98%, or 99% homology with, the nucleotide sequence of SEQ ID NO: 406. In an embodiment, the PII promoter comprises, or consists of, a nucleotide sequence that is the same as the nucleotide sequence of SEQ ID NO: 406.

In an embodiment, the N-ter NLS component comprises, or consists of, a nucleotide sequence that is the same as the nucleotide sequence of SEQ ID NO: 420 or a nucleotide sequence encoding the amino acid sequence of SEQ ID NO: 434.

In an embodiment, the Cas9 component comprises, or consists of, a nucleotide sequence that is the same as the nucleotide sequence of SEQ ID NO: 421 or a nucleotide sequence encoding the amino acid sequence of SEQ ID NO: 435.

In an embodiment, the C-ter NLS component comprises, or consists of, a nucleotide sequence that is the same as the nucleotide sequence of SEQ ID NO: 422 or a nucleotide sequence encoding the amino acid sequence of SEQ ID NO: 434.

In an embodiment, the poly(A) signal component comprises, or consists of, a nucleotide sequence that is the same as any of the nucleotide sequences disclosed in Table 26, or any of the nucleotide sequences of SEQ ID NOS: 424, 455 or 456. In an embodiment, the poly(A) signal component comprises, or consists of, a nucleotide sequence that is the same as the nucleotide sequence of SEQ ID NO: 424.

In an embodiment, the spacer 3 component comprises, or consists of, a nucleotide sequence that is the same as the nucleotide sequence of SEQ ID NO: 425.

In an embodiment, the right ITR component comprises, or consists of, a nucleotide sequence that is the same as any of the nucleotide sequences disclosed in Table 24, or any of the nucleotide sequences of SEQ ID NOS: 436-444.

In an embodiment, the recombinant AAV genome further comprises an affinity tag component (e.g., a 3×FLAG component). In an embodiment, the affinity tag component (e.g., the 3×FLAG component) comprises, or consists of, a nucleotide sequence that is the same as, differs by no more than 1, 2, 3, 4, or 5 nucleotides from, or has at least has at least 90%, 92%, 94%, 96%, 98%, or 99% homology with, the nucleotide sequence of SEQ ID NO: 423, or a nucleotide sequence encoding any of the amino acid sequences disclosed in Table 25 or any of the amino acid sequences of SEQ ID NO: 426 or 451-454.

In an embodiment, the affinity tag component (e.g., the 3×FLAG component) is between the C-ter NLS component and the poly(A) signal component. In an embodiment, the affinity tag component (e.g., the 3×FLAG component) comprises, or consists of, a nucleotide sequence that is the same as, the nucleotide sequence of SEQ ID NO: 423 or a nucleotide sequence encoding the amino acid sequence of SEQ ID NO: 426.

In an embodiment, the recombinant AAV genome comprises the nucleotide sequences of SEQ ID NOS: 408, 417, 418, 401, 420, 421, 422, 424, and 437.

In an embodiment, the recombinant AAV genome comprises the nucleotide sequences of SEQ ID NOS: 408, 417, 418, 402, 420, 421, 422, 424, and 437.

In an embodiment, the recombinant AAV genome comprises the nucleotide sequences of SEQ ID NOS: 408, 417, 418, 403, 420, 421, 422, 424, and 437.

In an embodiment, the recombinant AAV genome comprises the nucleotide sequences of SEQ ID NOS: 408, 417, 418, 404, 420, 421, 422, 424, and 437.

In an embodiment, the recombinant AAV genome comprises the nucleotide sequences of SEQ ID NOS: 408, 417, 418, 405, 420, 421, 422, 424, and 437.

In an embodiment, the recombinant AAV genome comprises the nucleotide sequences of SEQ ID NOS: 408, 417, 418, 406, 420, 421, 422, 424, and 437.

In an embodiment, the recombinant AAV genome further comprises the nucleotide sequences of SEQ ID NO: 416, 419, 425, and 427.

In an embodiment, the recombinant AAV genome further comprises the nucleotide sequence of SEQ ID NO: 423.

In an embodiment, the recombinant AAV genome comprises any of the nucleotide sequences of SEQ ID NOS: 428-433.

In an embodiment, the recombinant AAV genome comprises, or consists of, a nucleotide sequence that is the same as, differs by no more than 100, 200, 300, 400, or 500 nucleotides from, or has at least has at least 90%, 92%, 94%, 96%, 98%, or 99% homology with any of the nucleotide sequences shown in FIG. 19A-19G, 20A-20F, 21A-21F, 22A-22F, 23A-23F, or 24A-24F, or any of the nucleotide sequences of SEQ ID NOS: 428-433 or 436-444.

In an embodiment, the recombinant AAV genome comprises, or consists of, a nucleotide sequence that is the same as any of the nucleotide sequences shown in FIG. 19A-19G, 20A-20F, 21A-21F, 22A-22F, 23A-23F, or 24A-24F, or any of the nucleotide sequences of SEQ ID NOS: 428-433 or 436-444.

In an embodiment, the recombinant AAV genome comprises or consists of one or more (e.g., 2, 3, 4, 5, 6, 7, 8, 9, 10, 11, 12 or all) of the component sequences shown in FIG. 19A-19G, 20A-20F, 21A-21F, 22A-22F, 23A-23F, or 24A-24F, or Tables 19 or 24-26, or any of the nucleotide sequences of SEQ ID NOS: 428-433 or 436-444.

Unless otherwise indicated, when components of a recombinant AAV genome are described herein, the order can be as provided, but other orders are included as well. In other words, in an embodiment, the order is as set out in the text, but in other embodiments, the order can be different.

It is understood that the recombinant AAV genomes disclosed herein can be single stranded or double stranded. Disclosed herein are also the reverse, complementary form of any of the recombinant AAV genomes disclosed herein, and the double stranded form thereof.

In another aspect, disclosed herein is a nucleic acid molecule (e.g., an expression vector) that comprises a recombinant AAV genome disclosed herein. In an embodiment, the nucleic acid molecule further comprises a nucleotide sequence that encodes an antibiotic resistant gene (e.g., an Amp resistant gene). In an embodiment, the nucleic acid molecule further comprises replication origin sequence (e.g., a ColE1 origin, an M13 origin, or both).

In another aspect, disclosed herein is a recombinant AAV viral particle comprising a recombinant AAV genome disclosed herein.

In an embodiment, the recombinant AAV viral particle has any of the serotype disclosed herein, e.g., in Table 24, or a combination thereof. In another embodiment, the recombinant AAV viral particle has a tissue specificity of retinal pigment epithelium cells, photoreceptors, horizontal cells, bipolar cells, amacrine cells, ganglion cells, or a combination thereof.

In another aspect, disclosed herein is a method of producing a recombinant AAV viral particle disclosed herein comprising providing a recombinant AAV genome disclosed herein and one or more capsid proteins under conditions that allow for assembly of an AAV viral particle.

In another aspect, disclosed herein is a method of altering a cell comprising contacting the cell with a recombinant AAV viral particle disclosed herein.

In another aspect, disclosed herein is a method of treating a subject having or likely to develop LCA10 comprising contacting the subject (or a cell from the subject) with a recombinant viral particle disclosed herein.

In another aspect, disclosed herein is a recombinant AAV viral particle comprising a recombinant AAV genome disclosed herein for use in treating LCA10 in a subject.

In another aspect, disclosed herein is use of a recombinant AAV viral particle comprising a recombinant AAV genome disclosed herein in the manufacture of a medicament for treating LCA10 in a subject.

The gRNA molecules and methods, as disclosed herein, can be used in combination with a governing gRNA molecule, comprising a targeting domain which is complementary to a target domain on a nucleic acid that encodes a component of the CRISPR/Cas system introduced into a cell or subject. In an embodiment, the governing gRNA molecule targets a nucleic acid that encodes a Cas9 molecule or a nucleic acid that encodes a target gene gRNA molecule. In an embodiment, the governing gRNA comprises a targeting domain that is complementary to a target domain in a sequence that encodes a Cas9 component, e.g., a Cas9 molecule or target gene gRNA molecule. In an embodiment, the target domain is designed with, or has, minimal homology to other nucleic acid sequences in the cell, e.g., to minimize off-target cleavage. For example, the targeting domain on the governing gRNA can be selected to reduce or minimize off-target effects. In an embodiment, a target domain for a governing gRNA can be disposed in the control or coding region of a Cas9 molecule or disposed between a control region and a transcribed region. In an embodiment, a target domain for a governing gRNA can be disposed in the control or coding region of a target gene gRNA molecule or disposed between a control region and a transcribed region for a target gene gRNA. While not wishing to be bound by theory, in an embodiment, it is believed that altering, e.g., inactivating, a nucleic acid that encodes a Cas9 molecule or a nucleic acid that encodes a target gene gRNA molecule can be effected by cleavage of the targeted nucleic acid sequence or by binding of a Cas9 molecule/governing gRNA molecule complex to the targeted nucleic acid sequence.

The compositions, reaction mixtures and kits, as disclosed herein, can also include a governing gRNA molecule, e.g., a governing gRNA molecule disclosed herein, Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

BRIEF DESCRIPTION OF THE DRAWINGS

FIGS. 1A-1G are representations of several exemplary gRNAs.

FIG. 1A depicts a modular gRNA molecule derived in part (or modeled on a sequence in part) from *Streptococcus pyogenes* (*S. pyogenes*) as a duplexed structure (SEQ ID NOS: 42 and 43, respectively, in order of appearance);

FIG. 1B depicts a unimolecular (or chimeric) gRNA molecule derived in part from *S. pyogenes* as a duplexed structure (SEQ ID NO: 44);

FIG. 1C depicts a unimolecular gRNA molecule derived in part from *S. pyogenes* as a duplexed structure (SEQ ID NO: 45);

FIG. 1D depicts a unimolecular gRNA molecule derived in part from *S. pyogenes* as a duplexed structure (SEQ ID NO: 46);

FIG. 1E depicts a unimolecular gRNA molecule derived in part from *S. pyogenes* as a duplexed structure (SEQ ID NO: 47);

FIG. 1F depicts a modular gRNA molecule derived in part from *Streptococcus thermophilus* (*S. thermophilus*) as a duplexed structure (SEQ ID NOS: 48 and 49, respectively, in order of appearance);

FIG. 1G depicts an alignment of modular gRNA molecules of *S. pyogenes* and *S. thermophilus* (SEQ ID NOS: 50-53, respectively, in order of appearance).

FIGS. 2A-2G depict an alignment of Cas9 sequences from Chylinski et al. (RNA Biol. 2013; 10(5): 726-737). The N-terminal RuvC-like domain is boxed and indicated with a "Y". The other two RuvC-like domains are boxed and indicated with a "B". The HNH-like domain is boxed and indicated by a "G". Sm: *S. mutans* (SEQ ID NO: 1); Sp: *S. pyogenes* (SEQ ID NO: 2); St: *S. thermophilus* (SEQ ID NO: 3); Li: *L. innocua* (SEQ ID NO: 4). Motif: this is a motif based on the four sequences: residues conserved in all four sequences are indicated by single letter amino acid abbreviation; "*" indicates any amino acid found in the corresponding position of any of the four sequences; and "-" indicates any amino acid, e.g., any of the 20 naturally occurring amino acids.

FIGS. 3A-3B show an alignment of the N-terminal RuvC-like domain from the Cas9 molecules disclosed in Chylinski et al (SEQ ID NOS: 54-103, respectively, in order of appearance). The last line of FIG. 3B identifies 4 highly conserved residues.

FIGS. 4A-4B show an alignment of the N-terminal RuvC-like domain from the Cas9 molecules disclosed in Chylinski et al. with sequence outliers removed (SEQ ID NOS: 104-177, respectively, in order of appearance). The last line of FIG. 4B identifies 3 highly conserved residues.

FIGS. 5A-5C show an alignment of the HNH-like domain from the Cas9 molecules disclosed in Chylinski et al (SEQ ID NOS: 178-252, respectively, in order of appearance). The last line of FIG. 5C identifies conserved residues.

FIGS. 6A-6B show an alignment of the HNH-like domain from the Cas9 molecules disclosed in Chylinski et al. with sequence outliers removed (SEQ ID NOS: 253-302, respectively, in order of appearance). The last line of FIG. 6B identifies 3 highly conserved residues.

FIGS. 7A-7B depict an alignment of Cas9 sequences from *S. pyogenes* and *Neisseria meningitidis* (*N. meningitidis*). The N-terminal RuvC-like domain is boxed and indicated with a "Y". The other two RuvC-like domains are boxed and indicated with a "B". The HNH-like domain is boxed and indicated with a "G". Sp: *S. pyogenes*; Nm: *N. meningitidis*. Motif: this is a motif based on the two sequences: residues conserved in both sequences are indicated by a single amino acid designation; "*" indicates any amino acid found in the corresponding position of any of the two sequences; "-" indicates any amino acid, e.g., any of the 20 naturally occurring amino acids, and "-" indicates any amino acid, e.g., any of the 20 naturally occurring amino acids, or absent.

FIG. 8 shows a nucleic acid sequence encoding Cas9 of *N. meningitidis* (SEQ ID NO: 303). Sequence indicated by an "R" is an SV40 NLS; sequence indicated as "G" is an HA tag; and sequence indicated by an "0" is a synthetic NLS sequence; the remaining (unmarked) sequence is the open reading frame (ORF).

FIG. 9A shows the organization of the Cas9 domains, including amino acid positions, in reference to the two lobes of Cas9 (recognition (REC) and nuclease (NUC) lobes). FIG. 9B shows the percent homology of each domain across 83 Cas9 orthologs.)

FIG. 11A shows gene editing (% indels) as assessed by sequencing for *S. pyogenes* and *S. aureus* gRNAs when co-expressed with Cas9 in patient-derived IVS26 primary fibroblasts. FIG. 11B shows gene editing (% indels) as assessed by sequencing for *S. aureus* gRNAs when co-expressed with Cas9 in HEK293 cells.

FIG. 18A (SEQ ID NO: 2778) shows an exemplary structure of a unimolecular gRNA molecule derived in part from *S. pyogenes* as a duplexed structure. FIG. 18B (SEQ ID NO: 2779) shows an exemplary structure of a unimolecular gRNA molecule derived in part from *S. aureus* as a duplexed structure.

Figure 19B:
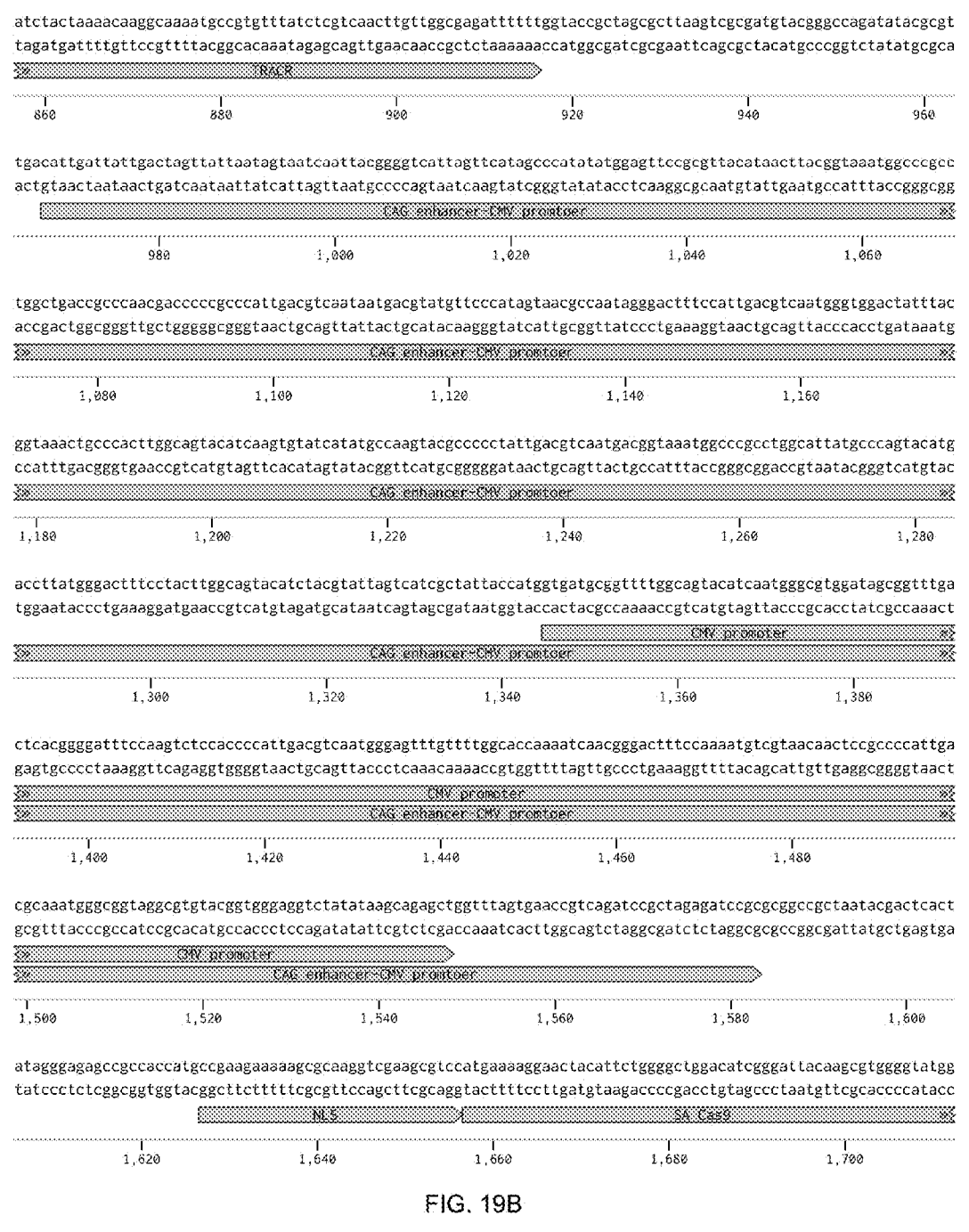

FIGS. 19A-19G depicts the nucleotide sequence of an exemplary recombinant AAV genome containing a CMV promoter. Various components of the recombinant AAV genome are also indicated. N=A, T, G or C. The number of N residues can vary, e.g., from 16 to 26 nucleotides. Upper stand: 5'→3' (SEQ ID NO: 428); lower stand: 3'→5' SEQ ID NO: 445).

Figure 20B:
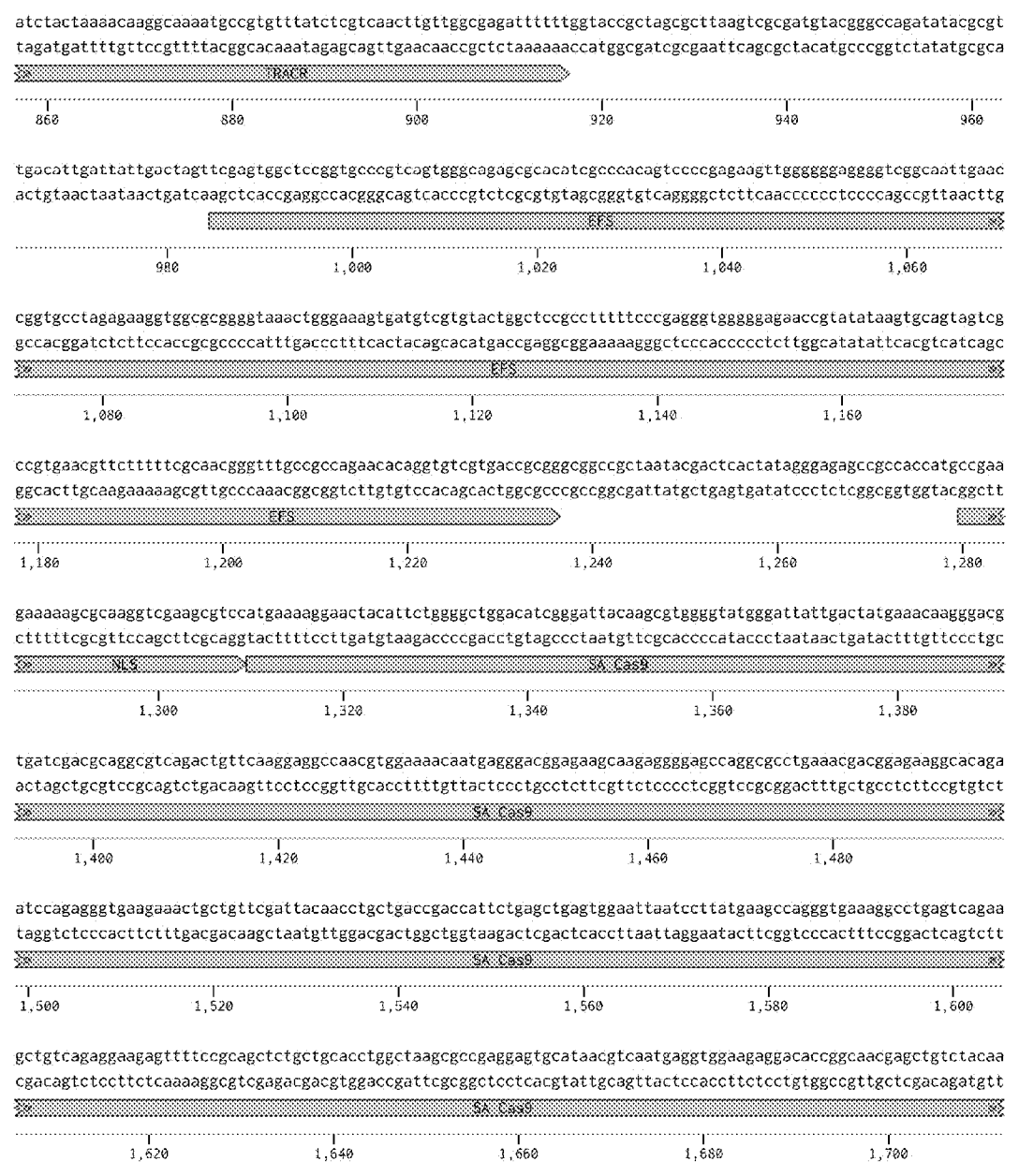

FIGS. 20A-20F depicts the nucleotide sequence of an exemplary recombinant AAV genome containing an EFS promoter. Various components of the recombinant AAV genome are also indicated. N=A, T, G or C. The number of N residues can vary, e.g., from 16 to 26 nucleotides. Upper stand: 5'→3' (SEQ ID NO: 429); lower stand: 3'→5' (SEQ ID NO: 446).

FIGS. 21A-21F depicts the nucleotide sequence of an exemplary recombinant AAV genome containing a CRK1 promoter. Various components of the recombinant AAV genome are also indicated. N=A, T, G or C. The number of N residues can vary, e.g., from 16 to 26 nucleotides. Upper stand: 5'→3' (SEQ ID NO: 430); lower stand: 3'→5' (SEQ ID NO: 447).

Figure 22B:
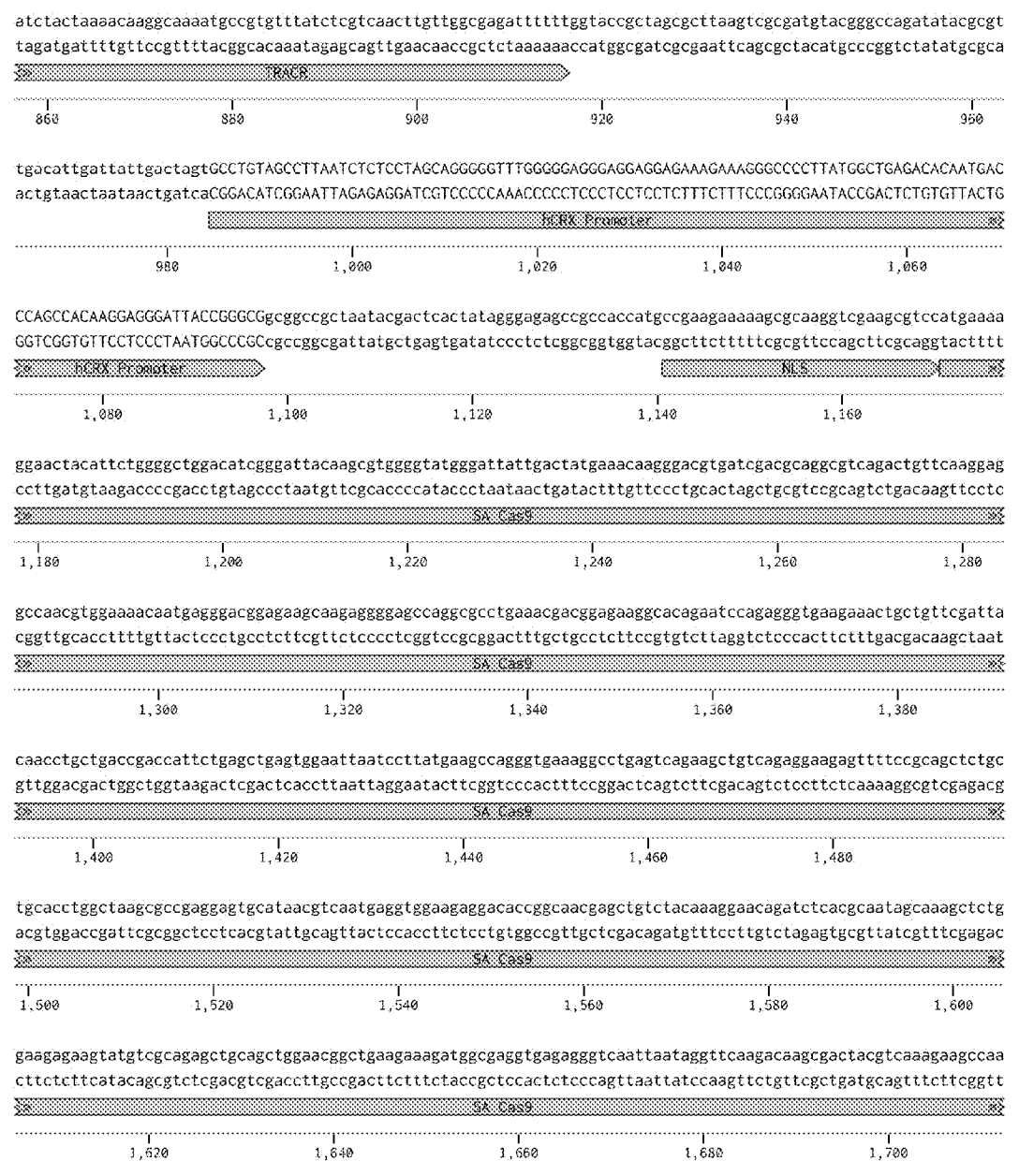

FIGS. 22A-22F depicts the nucleotide sequence of an exemplary recombinant AAV genome containing a CRX promoter. Various components of the recombinant AAV genome are also indicated. N=A, T, G or C. The number of N residues can vary, e.g., from 16 to 26 nucleotides. Upper stand: 5'→3' (SEQ ID NO: 431); lower stand: 3'→5' (SEQ ID NO: 448).

FIGS. 23A-23F depicts the nucleotide sequence of an exemplary recombinant AAV genome containing a NRL promoter. Various components of the recombinant AAV genome are also indicated. N=A, T, G or C. The number of N residues can vary, e.g., from 16 to 26 nucleotides. Upper stand: 5'→3' (SEQ ID NO: 432); lower stand: 3'→5' (SEQ ID NO: 449).

Figure 24D:
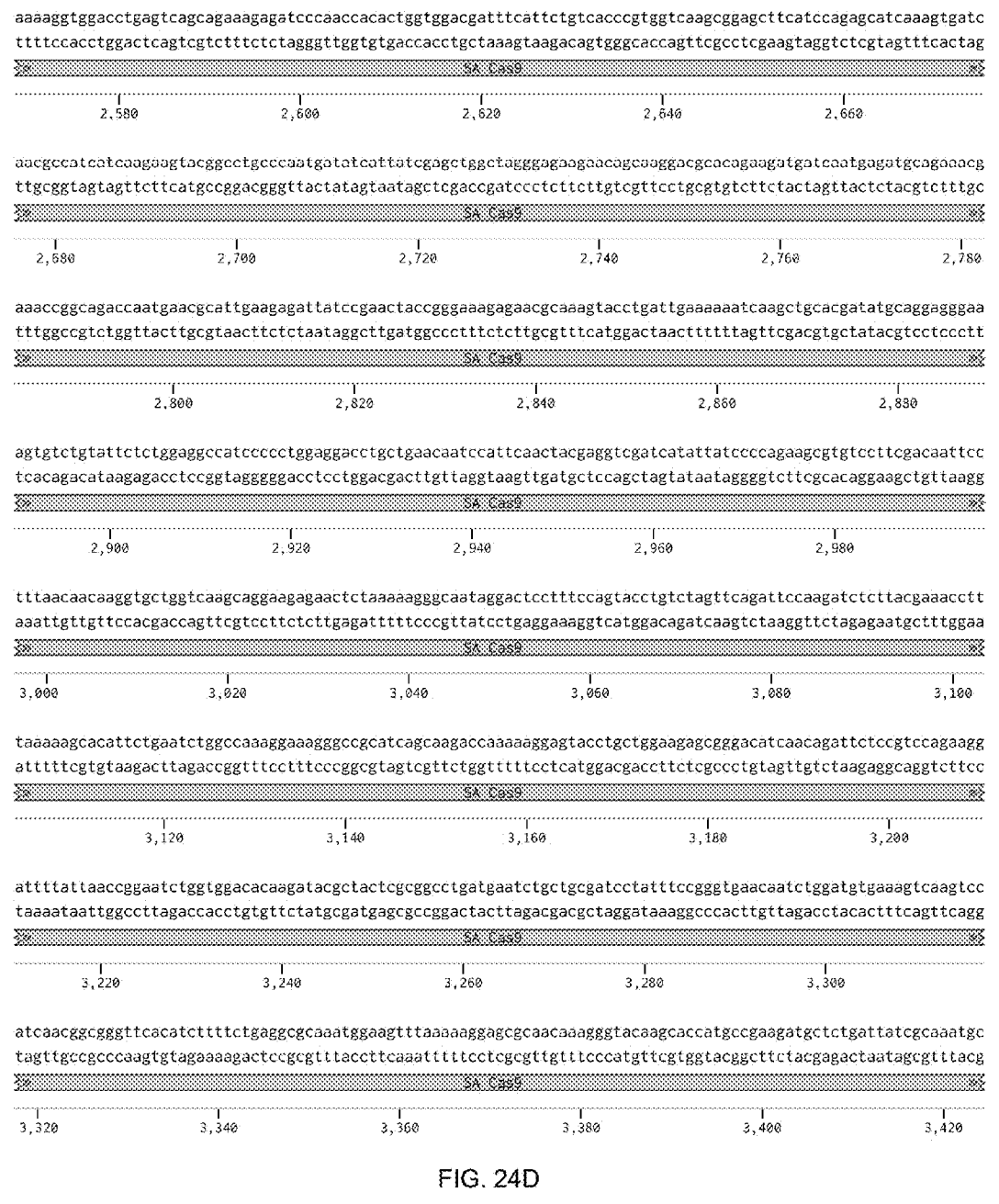
Figure 24E:
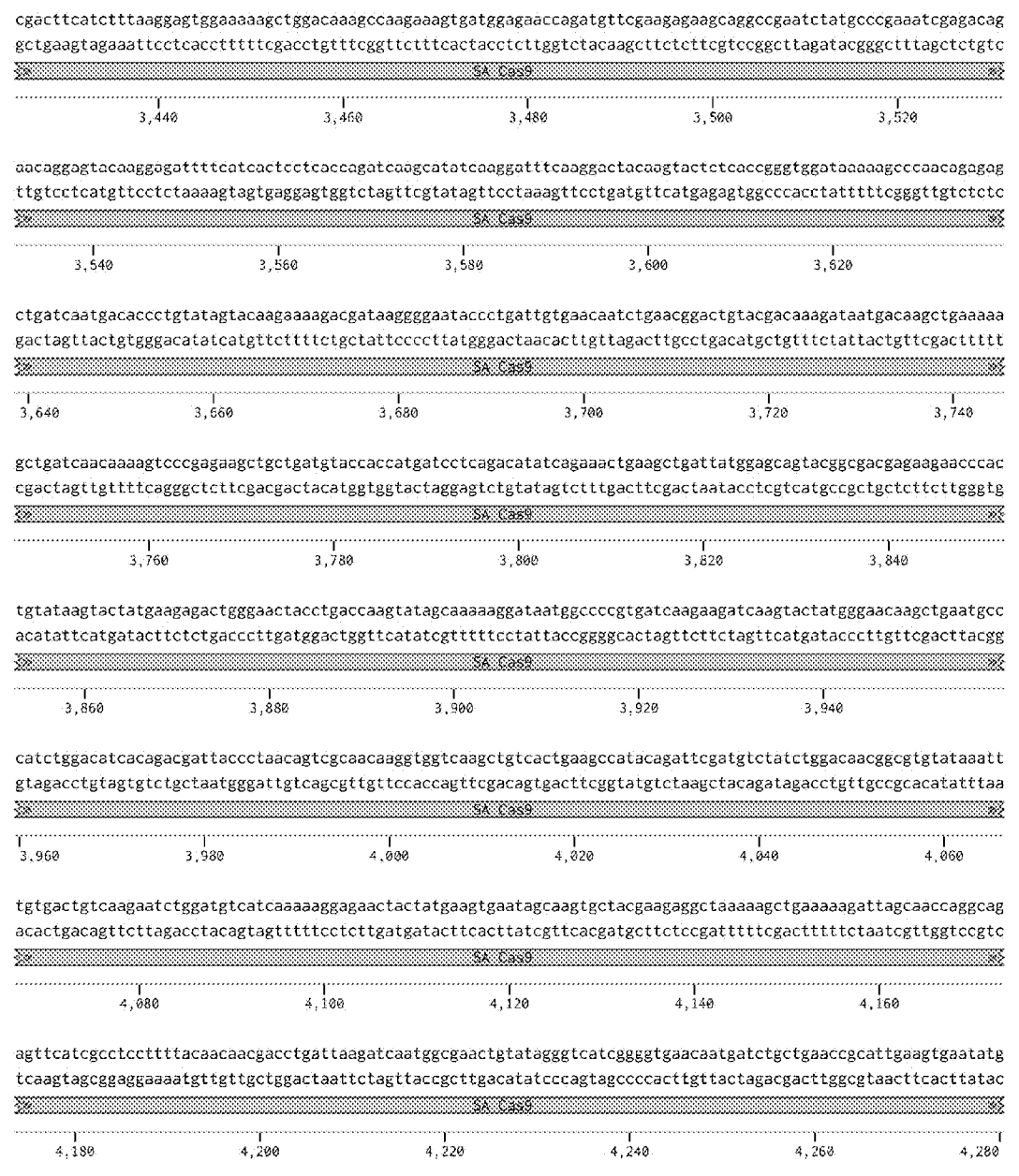

FIGS. 24A-24F depicts the nucleotide sequence of an exemplary recombinant AAV genome containing a NRL promoter. Various components of the recombinant AAV genome are also indicated. N=A, T, G or C. The number of N residues can vary, e.g., from 16 to 26 nucleotides. Upper stand: 5'→3' (SEQ ID NO: 433); lower stand: 3'→5' (SEQ ID NO: 450).

DETAILED DESCRIPTION

Definitions

Figure 1A:
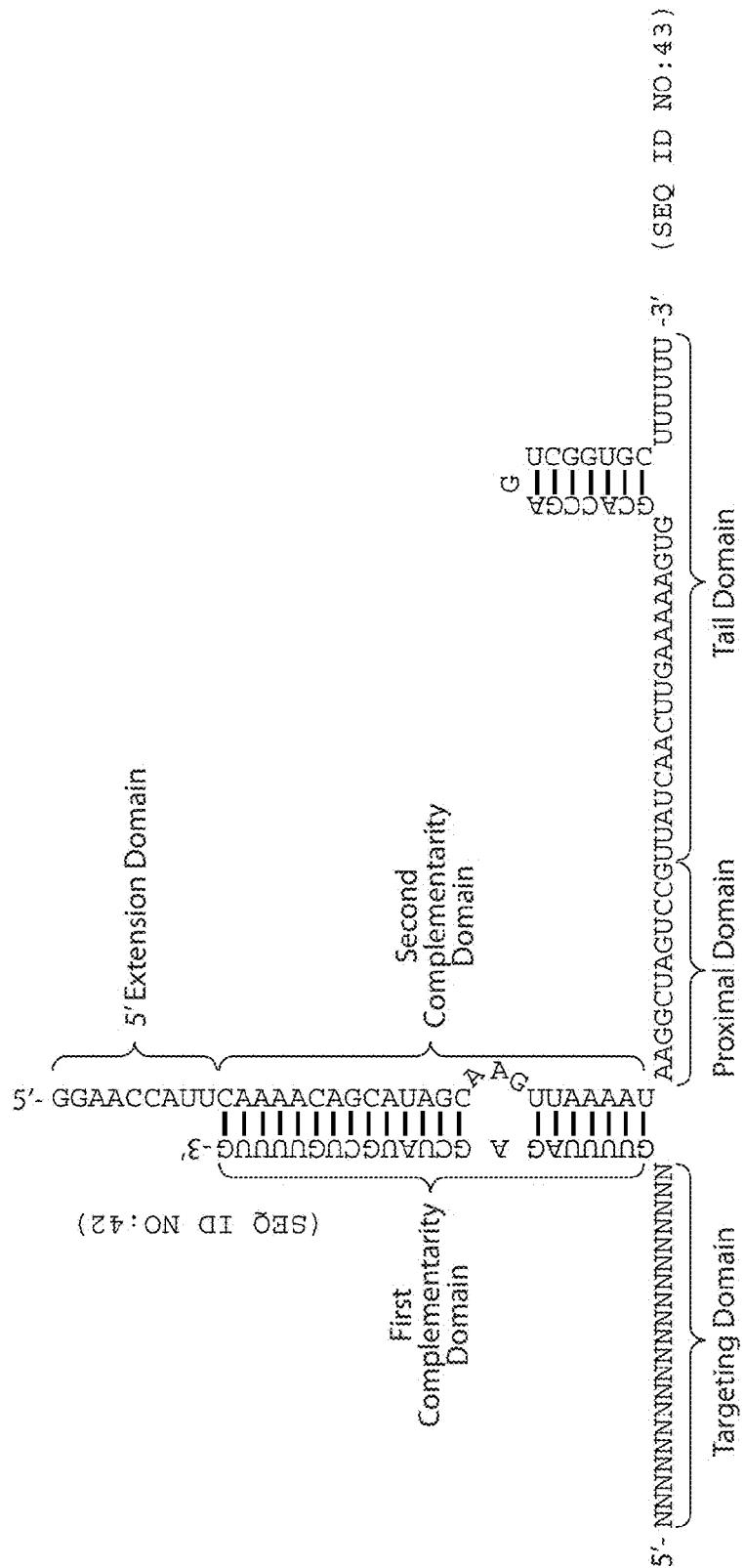

"Domain", as used herein, is used to describe segments of a protein or nucleic acid. Unless otherwise indicated, a domain is not required to have any specific functional property.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frameshift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Governing gRNA molecule", as used herein, refers to a gRNA molecule that comprises a targeting domain that is complementary to a target domain on a nucleic acid that comprises a sequence that encodes a component of the CRISPR/Cas system that is introduced into a cell or subject. A governing gRNA does not target an endogenous cell or subject sequence. In an embodiment, a governing gRNA molecule comprises a targeting domain that is complementary with a target sequence on: (a) a nucleic acid that encodes a Cas9 molecule; (b) a nucleic acid that encodes a gRNA which comprises a targeting domain that targets the CEP290 gene (a target gene gRNA); or on more than one nucleic acid that encodes a CRISPR/Cas component, e.g., both (a) and (b). In an embodiment, a nucleic acid molecule that encodes a CRISPR/Cas component, e.g., that encodes a Cas9 molecule or a target gene gRNA, comprises more than one target domain that is complementary with a governing gRNA targeting domain. While not wishing to be bound by theory, it is believed that a governing gRNA molecule complexes with a Cas9 molecule and results in Cas9 mediated inactivation of the targeted nucleic acid, e.g., by cleavage or by binding to the nucleic acid, and results in cessation or reduction of the production of a CRISPR/Cas system component. In an embodiment, the Cas9 molecule forms two complexes: a complex comprising a Cas9 molecule with a target gene gRNA, which complex will alter the CEP290 gene; and a complex comprising a Cas9 molecule with a governing gRNA molecule, which complex will act to prevent further production of a CRISPR/Cas system component, e.g., a Cas9 molecule or a target gene gRNA molecule. In an embodiment, a governing gRNA molecule/Cas9 molecule complex binds to or promotes cleavage of a control region sequence, e.g., a promoter, operably linked to a sequence that encodes a Cas9 molecule, a sequence that encodes a transcribed region, an exon, or an intron, for the Cas9 molecule. In an embodiment, a governing gRNA molecule/Cas9 molecule complex binds to or promotes cleavage of a control region sequence, e.g., a promoter, operably linked to a gRNA molecule, or a sequence that encodes the gRNA molecule. In an embodiment, the governing gRNA, e.g., a Cas9-targeting governing gRNA molecule, or a target gene gRNA-targeting governing gRNA molecule, limits the effect of the Cas9 molecule/target gene gRNA molecule complex-mediated gene targeting. In an embodiment, a governing gRNA places temporal, level of expression, or other limits, on activity of the Cas9 molecule/target gene gRNA molecule complex. In an embodiment, a governing gRNA reduces off-target or other unwanted activity. In an embodiment, a governing gRNA molecule inhibits, e.g., entirely or substantially entirely inhibits, the production of a component of the Cas9 system and thereby limits, or governs, its activity.

"Modulator", as used herein, refers to an entity, e.g., a drug that can alter the activity (e.g., enzymatic activity, transcriptional activity, or translational activity), amount, distribution, or structure of a subject molecule or genetic sequence. In an embodiment, modulation comprises cleavage, e.g., breaking of a covalent or non-covalent bond, or the forming of a covalent or non-covalent bond, e.g., the attachment of a moiety, to the subject molecule. In an embodiment, a modulator alters the, three dimensional, secondary, tertiary, or quaternary structure, of a subject molecule. A modulator can increase, decrease, initiate, or eliminate a subject activity.

"Large molecule", as used herein, refers to a molecule having a molecular weight of at least 2, 3, 5, 10, 20, 30, 40, 50, 60, 70, 80, 90, or 100 kD. Large molecules include proteins, polypeptides, nucleic acids, biologics, and carbohydrates.

"Polypeptide", as used herein, refers to a polymer of amino acids having less than 100 amino acid residues. In an embodiment, it has less than 50, 20, or 10 amino acid residues.

"Non-homologous end joining" or "NHEJ", as used herein, refers to ligation mediated repair and/or non-template mediated repair including, e.g., canonical NHEJ (cNHEJ), alternative NHEJ (altNHEJ), microhomology-mediated end joining (MMEJ), single-strand annealing (SSA), and synthesis-dependent microhomology-mediated end joining (SD-MMEJ).

"Reference molecule", e.g., a reference Cas9 molecule or reference gRNA, as used herein, refers to a molecule to which a subject molecule, e.g., a subject Cas9 molecule of subject gRNA molecule, e.g., a modified or candidate Cas9 molecule is compared. For example, a Cas9 molecule can be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of *S. pyogenes, S. aureus,* or *S. thermophilus*. In an embodiment, the reference Cas9 molecule is the naturally occurring Cas9 molecule having the closest sequence identity or homology with the Cas9 molecule to which it is being compared. In an embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Small molecule", as used herein, refers to a compound having a molecular weight less than about 2 kD, e.g., less than about 2 kD, less than about 1.5 kD, less than about 1 kD, or less than about 0.75 kD.

"Subject", as used herein, means either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In an embodiment, the subject is a human. In other embodiments, the subject is poultry.

"Treat", "treating" and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

"X" as used herein in the context of an amino acid sequence, refers to any amino acid (e.g., any of the twenty natural amino acids) unless otherwise specified.

Methods of Altering CEP290

CEP290 encodes a centrosomal protein that plays a role in centrosome and cilia development. The CEP290 gene is involved in forming cilia around cells, particularly in the photoreceptors at the back of the retina, which are needed to detect light and color.

Disclosed herein are methods and compositions for altering the LCA10 target position in the CEP290 gene. LCA10 target position can be altered (e.g., corrected) by gene editing, e.g., using CRISPR-Cas9 mediated methods. The alteration (e.g., correction) of the mutant CEP290 gene can be mediated by any mechanism. Exemplary mechanisms that can be associated with the alteration (e.g., correction) of the mutant CEP290 gene include, but are not limited to, non-homologous end joining (e.g., classical or alternative), microhomology-mediated end joining (MMEJ), homology-directed repair (e.g., endogenous donor template mediated), SDSA (synthesis dependent strand annealing), single strand annealing or single strand invasion. Methods described herein introduce one or more breaks near the site of the LCA target position (e.g., c.2991+1655A to G) in at least one allele of the CEP290 gene. In an embodiment, the one or more breaks are repaired by NHEJ. During repair of the one or more breaks, DNA sequences are inserted and/or deleted resulting in the loss or destruction of the cryptic splice site resulting from the mutation at the LCA10 target position (e.g., c.2991+1655A to G). The method can include acquiring knowledge of the mutation carried by the subject, e.g., by sequencing the appropriate portion of the CEP290 gene.

Altering the LCA10 target position refers to (1) break-induced introduction of an indel (also referred to herein as NHEJ-mediated introduction of an indel) in close proximity to or including a LCA10 target position (e.g., c.2991+1655A to G), or (2) break-induced deletion (also referred to herein as NHEJ-mediated deletion) of genomic sequence including the mutation at a LCA10 target position (e.g., c.2991+ 1655A to G). Both approaches give rise to the loss or destruction of the cryptic splice site.

Figure 9A:
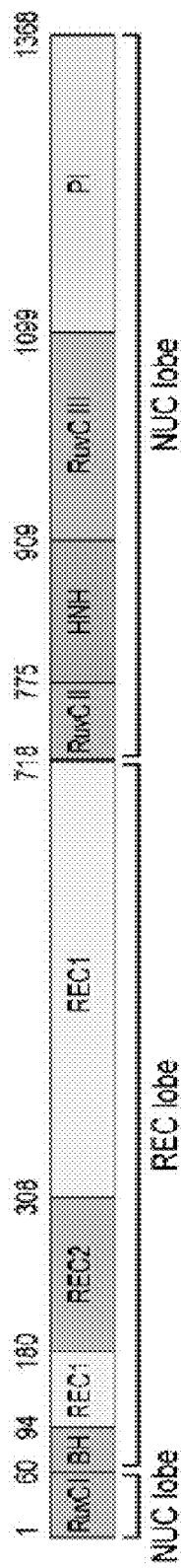
FIGS. 9A-9B are schematic representations of the domain organization of *S. pyogenes* Cas 9.
Figure 9B:
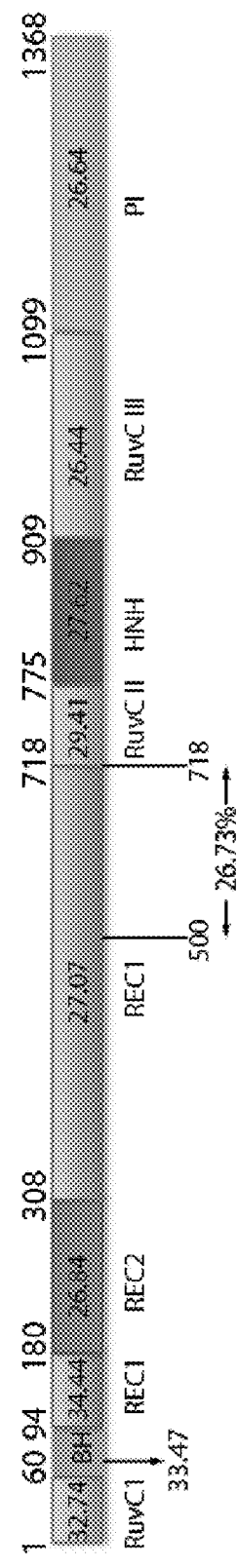

In an embodiment, the method comprises introducing a break-induced indel in close proximity to or including the LCA10 target position (e.g., c.2991+1655A to G). As described herein, in one embodiment, the method comprises the introduction of a double strand break sufficiently close to (e.g., either 5' or 3' to) the LCA10 target position, e.g., c.2991+1655A to G, such that the break-induced indel could be reasonably expected to span the mutation. A single gRNAs, e.g., unimolecular (or chimeric) or modular gRNA molecules, is configured to position a double strand break sufficiently close to the LCA10 target position in the CEP290 gene. In an embodiment, the break is positioned to avoid unwanted target chromosome elements, such as repeat elements, e.g., an Alu repeat. The double strand break may be positioned within 40 nucleotides (e.g., within 1, 2, 3, 4, 5, 10, 15, 16, 17, 18, 19, 20, 25, 30, 35 or 40 nucleotides) upstream of the LCA10 target position, or within 40 nucleotides (e.g., within 1, 2, 3, 4, 5, 10, 15, 16, 17, 18, 19, 20, 25, 30, 35 or 40 nucleotides) downstream of the LCA10 target position (see FIG. 9). While not wishing to be bound by theory, in an embodiment, it is believed that NHEJ-mediated repair of the double strand break allows for the NHEJ-mediated introduction of an indel in close proximity to or including the LCA10 target position.

In another embodiment, the method comprises the introduction of a pair of single strand breaks sufficiently close to (either 5' or 3' to, respectively) the mutation at the LCA10 target position (e.g., c.2991+1655A to G) such that the break-induced indel could be reasonably expected to span the mutation. Two gRNAs, e.g., unimolecular (or chimeric) or modular gRNA molecules, are configured to position the two single strand breaks sufficiently close to the LCA10 target position in the CEP290 gene. In an embodiment, the breaks are positioned to avoid unwanted target chromosome elements, such as repeat elements, e.g., an Alu repeat. In an embodiment, the pair of single strand breaks is positioned within 40 nucleotides (e.g., within 1, 2, 3, 4, 5, 10, 15, 16, 17, 18, 19, 20, 25, 30, 35 or 40 nucleotides) upstream of the LCA10 target position, or within 40 nucleotides (e.g., within 1, 2, 3, 4, 5, 10, 15, 16, 17, 18, 19, 20, 25, 30, 35 or 40 nucleotides) downstream of the LCA10 target position (see FIG. 9). While not wishing to be bound by theory, in an embodiment, it is believed that NHEJ mediated repair of the pair of single strand breaks allows for the NHEJ-mediated introduction of an indel in close proximity to or including the LCA10 target position. In an embodiment, the pair of single strand breaks may be accompanied by an additional double strand break, positioned by a third gRNA molecule, as is discussed below. In another embodiment, the pair of single strand breaks may be accompanied by two additional single strand breaks positioned by a third gRNA molecule and a fourth gRNA molecule, as is discussed below.

Figure 10:
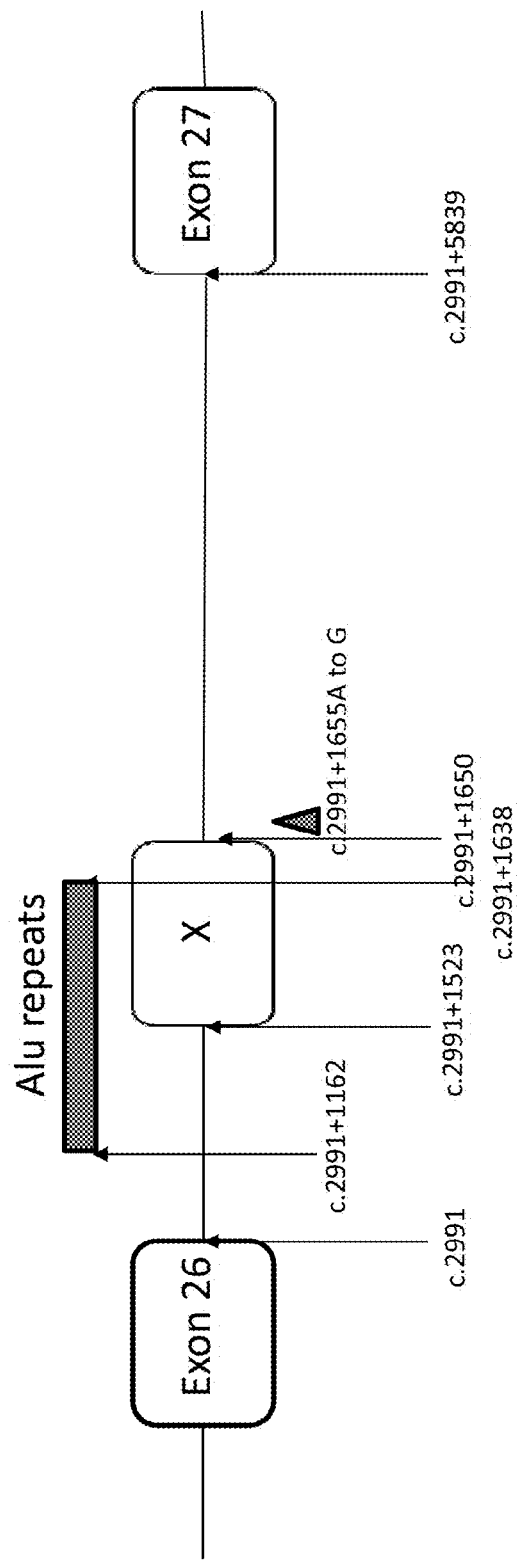
FIG. 10 shows the nucleotide locations of the Alu repeats, cryptic exon and point mutation, c.2991+1655 A to G in the human CEP290 locus. "X" indicates the cryptic exon. The blue triangle indicates the LCA target position c.2991+1655A to G.

In an embodiment, the method comprises introducing a break-induced deletion of genomic sequence including the mutation at the LCA10 target position (e.g., c.2991+1655A to G). As described herein, in one embodiment, the method comprises the introduction of two double strand breaks—one 5' and the other 3' to (i.e., flanking) the LCA10 target position. Two gRNAs, e.g., unimolecular (or chimeric) or modular gRNA molecules, are configured to position the two double strand breaks on opposite sides of the LCA10 target position in the CEP290 gene. In an embodiment, the first double strand break is positioned upstream of the LCA10 target position within intron 26 (e.g., within 1654 nucleotides), and the second double strand break is positioned downstream of the LCA10 target position within intron 26 (e.g., within 4183 nucleotides) (see FIG. 10). In an embodiment, the breaks (i.e., the two double strand breaks) are positioned to avoid unwanted target chromosome elements, such as repeat elements, e.g., an Alu repeat, or the endogenous CEP290 splice sites.

The first double strand break may be positioned as follows:
(1) upstream of the 5' end of the Alu repeat in intron 26,
(2) between the 3' end of the Alu repeat and the LCA10 target position in intron 26, or
(3) within the Alu repeat provided that a sufficient length of the gRNA fall outside of the repeat so as to avoid binding to other Alu repeats in the genome, and the second double strand break to be paired with the first double strand break may be positioned downstream of the LCA10 target position in intron 26.

For example, the first double strand break may be positioned:
(1) within 1162 nucleotides upstream of the 5' end of the Alu repeat,
(2) within 1000 nucleotides upstream of the 5' end of the Alu repeat,
(3) within 900 nucleotides upstream of the 5' end of the Alu repeat,
(4) within 800 nucleotides upstream of the 5' end of the Alu repeat,
(5) within 700 nucleotides upstream of the 5' end of the Alu repeat,
(6) within 600 nucleotides upstream of the 5' end of the Alu repeat,
(7) within 500 nucleotides upstream of the 5' end of the Alu repeat,
(8) within 400 nucleotides upstream of the 5' end of the Alu repeat,
(9) within 300 nucleotides upstream of the 5' end of the Alu repeat,
(10) within 200 nucleotides upstream of the 5' end of the Alu repeat,
(11) within 100 nucleotides upstream of the 5' end of the Alu repeat,
(12) within 50 nucleotides upstream of the 5' end of the Alu repeat,
(13) within the Alu repeat provided that a sufficient length of the gRNA falls outside of the repeat so as to avoid binding to other Alu repeats in the genome,
(14) within 40 nucleotides (e.g., within 1, 2, 3, 4, 5, 10, 15, 16, 17, 18, 19, 20, 25, 30, 35 or 40 nucleotides) upstream of the LCA10 target position, or
(15) within 17 nucleotides (e.g., within 1, 2, 3, 4, 5, 10, 15, 16 or 17 nucleotides) upstream of the LCA10 target position, and the second double strand breaks to be paired with the first double strand break may be positioned:
(1) within 4183 nucleotides downstream of the LCA10 target position,
(2) within 4000 nucleotides downstream of the LCA10 target position,
(3) within 3000 nucleotides downstream of the LCA10 target position,
(4) within 2000 nucleotides downstream of the LCA10 target position,
(5) within 1000 nucleotides downstream of the LCA10 target position,
(6) within 700 nucleotides downstream of the LCA10 target position,
(7) within 500 nucleotides downstream of the LCA10 target position,
(8) within 300 nucleotides downstream of the LCA10 target position,
(9) within 100 nucleotides downstream of the LCA10 target position,
(10) within 60 nucleotides downstream of the LCA10 target position, or
(11) within 40 (e.g., 1, 2, 3, 4, 5, 10, 15, 20, 25, 30, 35 or 40 nucleotides)
nucleotides downstream of the LCA10 target position.

While not wishing to be bound by theory, in an embodiment, it is believed that the two double strand breaks allow for break-induced deletion of genomic sequence including the mutation at the LCA10 target position in the CEP290 gene.

The method also comprises the introduction of two sets of breaks, e.g., one double strand break (either 5' or 3' to the mutation at the LCA10 target position, e.g., c.2991+1655A to G) and a pair of single strand breaks (on the other side of the LCA10 target position opposite from the double strand break) such that the two sets of breaks are positioned to flank the LCA10 target position. Three gRNAs, e.g., unimolecular (or chimeric) or modular gRNA molecules, are configured to position the one double strand break and the pair of single strand breaks on opposite sides of the LCA10 target position in the CEP290 gene. In an embodiment, the first set of breaks (either the double strand break or the pair of single strand breaks) is positioned upstream of the LCA10 target position within intron 26 (e.g., within 1654 nucleotides), and the second set of breaks (either the double strand break or the pair of single strand breaks) are positioned downstream of the LCA10 target position within intron 26 (e.g., within 4183 nucleotides) (see FIG. 10). In an embodiment, the two sets of breaks (i.e., the double strand break and the pair of single strand breaks) are positioned to avoid unwanted target chromosome elements, such as repeat elements, e.g., an Alu repeat, or the endogenous CEP290 splice sites.

The first set of breaks (either the double strand break or the pair of single strand breaks) may be positioned:
(1) upstream of the 5' end of the Alu repeat in intron 26,
(2) between the 3' end of the Alu repeat and the LCA10 target position in intron 26, or
(3) within the Alu repeat provided that a sufficient length of the gRNA falls
outside of the repeat so as to avoid binding to other Alu repeats in the genome, and the second set of breaks to be paired with the first set of breaks (either the double strand break or the pair of single strand breaks) may be positioned downstream of the LCA10 target position in intron 26.

For example, the first set of breaks (either the double strand break or the pair of single strand breaks) may be positioned:

(1) within 1162 nucleotides upstream of the 5' end of the Alu repeat,
(2) within 1000 nucleotides upstream of the 5' end of the Alu repeat,
(3) within 900 nucleotides upstream of the 5' end of the Alu repeat,
(4) within 800 nucleotides upstream of the 5' end of the Alu repeat,
(5) within 700 nucleotides upstream of the 5' end of the Alu repeat,
(6) within 600 nucleotides upstream of the 5' end of the Alu repeat,
(7) within 500 nucleotides upstream of the 5' end of the Alu repeat,
(8) within 400 nucleotides upstream of the 5' end of the Alu repeat,
(9) within 300 nucleotides upstream of the 5' end of the Alu repeat,
(10) within 200 nucleotides upstream of the 5' end of the Alu repeat,
(11) within 100 nucleotides upstream of the 5' end of the Alu repeat,
(12) within 50 nucleotides upstream of the 5' end of the Alu repeat,
(13) within the Alu repeat provided that a sufficient length of the gRNA falls outside of the repeat so as to avoid binding to other Alu repeats in the genome,
(14) within 40 nucleotides (e.g., within 1, 2, 3, 4, 5, 10, 15, 16, 17, 18, 19, 20, 25, 30, 35 or 40 nucleotides) upstream of the LCA10 target position, or
(15) within 17 nucleotides (e.g., within 1, 2, 3, 4, 5, 10, 15, 16 or 17 nucleotides)
upstream of the LCA10 target position,
and the second set of breaks to be paired with the first set of breaks (either the double strand break or the pair of single strand breaks) may be positioned:
(1) within 4183 nucleotides downstream of the LCA10 target position,
(2) within 4000 nucleotides downstream of the LCA10 target position,
(3) within 3000 nucleotides downstream of the LCA10 target position,
(4) within 2000 nucleotides downstream of the LCA10 target position,
(5) within 1000 nucleotides downstream of the LCA10 target position,
(6) within 700 nucleotides downstream of the LCA10 target position,
(7) within 500 nucleotides downstream of the LCA10 target position,
(8) within 300 nucleotides downstream of the LCA10 target position,
(9) within 100 nucleotides downstream of the LCA10 target position,
(10) within 60 nucleotides downstream of the LCA10 target position, or
(11) within 40 (e.g., 1, 2, 3, 4, 5, 10, 15, 20, 25, 30, 35 or 40 nucleotides)
nucleotides downstream of the LCA10 target position.

While not wishing to be bound by theory, it is believed that the two sets of breaks (either the double strand break or the pair of single strand breaks) allow for break-induced deletion of genomic sequence including the mutation at the LCA10 target position in the CEP290 gene.

The method also comprises the introduction of two sets of breaks, e.g., two pairs of single strand breaks, wherein the two sets of single-stranded breaks are positioned to flank the LCA10 target position. In an embodiment, the first set of breaks (e.g., the first pair of single strand breaks) is 5' to the mutation at the LCA10 target position (e.g., c.2991+1655A to G) and the second set of breaks (e.g., the second pair of single strand breaks) is 3' to the mutation at the LCA10 target position. Four gRNAs, e.g., unimolecular (or chimeric) or modular gRNA molecules, are configured to position the two pairs of single strand breaks on opposite sides of the LCA10 target position in the CEP290 gene. In an embodiment, the first set of breaks (e.g., the first pair of single strand breaks) is positioned upstream of the LCA10 target position within intron 26 (e.g., within 1654 nucleotides), and the second set of breaks (e.g., the second pair of single strand breaks) is positioned downstream of the LCA10 target position within intron 26 (e.g., within 4183 nucleotides) (see FIG. 10). In an embodiment, the two sets of breaks (i.e., the two pairs of single strand breaks) are positioned to avoid unwanted target chromosome elements, such as repeat elements, e.g., an Alu repeat, or the endogenous CEP290 splice sites.

The first set of breaks (e.g., the first pair of single strand breaks) may be positioned:
(1) upstream of the 5' end of the Alu repeat in intron 26,
(2) between the 3' end of the Alu repeat and the LCA10 target position in intron 26, or
(3) within the Alu repeat provided that a sufficient length of the gRNA falls outside of the repeat so as to avoid binding to other Alu repeats in the genome, and the second set of breaks to be paired with the first set of breaks (e.g., the second pair of single strand breaks) may be positioned downstream of the LCA10 target position in intron 26.

For example, the first set of breaks (e.g., the first pair of single strand breaks) may be positioned:
(1) within 1162 nucleotides upstream of the 5' end of the Alu repeat,
(2) within 1000 nucleotides upstream of the 5' end of the Alu repeat,
(3) within 900 nucleotides upstream of the 5' end of the Alu repeat,
(4) within 800 nucleotides upstream of the 5' end of the Alu repeat,
(5) within 700 nucleotides upstream of the 5' end of the Alu repeat,
(6) within 600 nucleotides upstream of the 5' end of the Alu repeat,
(7) within 500 nucleotides upstream of the 5' end of the Alu repeat,
(8) within 400 nucleotides upstream of the 5' end of the Alu repeat,
(9) within 300 nucleotides upstream of the 5' end of the Alu repeat,
(10) within 200 nucleotides upstream of the 5' end of the Alu repeat,
(11) within 100 nucleotides upstream of the 5' end of the Alu repeat,
(12) within 50 nucleotides upstream of the 5' end of the Alu repeat,
(13) within the Alu repeat provided that a sufficient length of the gRNA falls outside of the repeat so as to avoid binding to other Alu repeats in the genome,
(14) within 40 nucleotides (e.g., within 1, 2, 3, 4, 5, 10, 15, 16, 17, 18, 19, 20, 25, 30, 35 or 40 nucleotides) upstream of the LCA10 target position, or
(15) within 17 nucleotides (e.g., within 1, 2, 3, 4, 5, 10, 15, 16 or 17 nucleotides) upstream of the LCA10 target position, and the second set of breaks to be paired with the first set of breaks (e.g., the second pair of single strand breaks) may be positioned:

(1) within 4183 nucleotides downstream of the LCA10 target position,
(2) within 4000 nucleotides downstream of the LCA10 target position,
(3) within 3000 nucleotides downstream of the LCA10 target position,
(4) within 2000 nucleotides downstream of the LCA10 target position,
(5) within 1000 nucleotides downstream of the LCA10 target position,
(6) within 700 nucleotides downstream of the LCA10 target position,
(7) within 500 nucleotides downstream of the LCA10 target position,
(8) within 300 nucleotides downstream of the LCA10 target position,
(9) within 100 nucleotides downstream of the LCA10 target position,
(10) within 60 nucleotides downstream of the LCA10 target position, or
(11) within 40 (e.g., 1, 2, 3, 4, 5, 10, 15, 20, 25, 30, 35 or 40 nucleotides) nucleotides downstream of the LCA10 target position.

While not wishing to be bound by theory, it is believed that the two sets of breaks (e.g., the two pairs of single strand breaks) allow for break-induced deletion of genomic sequence including the mutation at the LCA10 target position in the CEP290 gene.

Methods to Treat or Prevent LCA10

Described herein are methods for treating or delaying the onset or progression of Leber's Congenital Amaurosis 10 (LCA10) caused by a c.2991+1655 A to G (adenine to guanine) mutation in the CEP290 gene. The disclosed methods for treating or delaying the onset or progression of LCA10 alter the CEP290 gene by genome editing using a gRNA targeting the LCA10 target position and a Cas9 enzyme. Details on gRNAs targeting the LCA10 target position and Cas9 enzymes are provided below.

In an embodiment, treatment is initiated prior to onset of the disease.

In an embodiment, treatment is initiated after onset of the disease.

In an embodiment, treatment is initiated prior to loss of visual acuity and/or sensitivity to glare.

In an embodiment, treatment is initiated at onset of loss of visual acuity.

In an embodiment, treatment is initiated after onset of loss of visual acuity and/or sensitivity to glare.

In an embodiment, treatment is initiated in utero.

In an embodiment, treatment is initiated after birth.

In an embodiment, treatment is initiated prior to the age of 1.

In an embodiment, treatment is initiated prior to the age of 2.

In an embodiment, treatment is initiated prior to the age of 5.

In an embodiment, treatment is initiated prior to the age of 10.

In an embodiment, treatment is initiated prior to the age of 15.

In an embodiment, treatment is initiated prior to the age of 20.

A subject's vision can evaluated, e.g., prior to treatment, or after treatment, e.g., to monitor the progress of the treatment. In an embodiment, the subject's vision is evaluated prior to treatment, e.g., to determine the need for treatment. In an embodiment, the subject's vision is evaluated after treatment has been initiated, e.g., to access the effectiveness of the treatment. Vision can be evaluated by one or more of: evaluating changes in function relative to the contralateral eye, e.g., by utilizing retinal analytical techniques; by evaluating mean, median and distribution of change in best corrected visual acuity (BCVA); evaluation by Optical Coherence Tomography; evaluation of changes in visual field using perimetry; evaluation by full-field electroretinography (ERG); evaluation by slit lamp examination; evaluation of intraocular pressure; evaluation of autofluorescence, evaluation with fundoscopy; evaluation with fundus photography; evaluation with fluorescein angiography (FA); or evaluation of visual field sensitivity (FFST).

In an embodiment, a subject's vision may be assessed by measuring the subject's mobility, e.g., the subject's ability to maneuver in space.

In an embodiment, treatment is initiated in a subject who has tested positive for a mutation in the CEP290 gene, e.g., prior to disease onset or in the earliest stages of disease.

In an embodiment, a subject has a family member that has been diagnosed with LCA10. For example, the subject has a family member that has been diagnosed with LCA10, and the subject demonstrates a symptom or sign of the disease or has been found to have a mutation in the CEP290 gene.

In an embodiment, a cell (e.g., a retinal cell, e.g., a photoreceptor cell) from a subject suffering from or likely to develop LCA10 is treated ex vivo. In an embodiment, the cell is removed from the subject, altered as described herein, and introduced into, e.g., returned to, the subject.

In an embodiment, a cell (e.g., a retinal cell, e.g., a photoreceptor cell) altered to correct a mutation in the LCA10 target position is introduced into the subject.

In an embodiment, the cell is a retinual cell (e.g., retinal pigment epithelium cell), a photoreceptor cell, a horizontal cell, a bipolar cell, an amacrine cell, or a ganglion cell. In an embodiment, it is contemplated herein that a population of cells (e.g., a population of retinal cells, e.g., a population of photoreceptor cells) from a subject may be contacted ex vivo to alter a mutation in CEP290, e.g., a 2991+1655 A to G. In an embodiment, such cells are introduced to the subject's body to prevent or treat LCA10.

In an embodiment, the population of cells are a population of retinual cells (e.g., retinal pigment epithelium cells), photoreceptor cells, horizontal cells, bipolar cells, amacrine cells, ganglion cells, or a combination thereof.

In an embodiment, the method described herein comprises delivery of gRNA or other components described herein, e.g., a Cas9 molecule, by one or more AAV vectors, e.g., one or more AAV vectors described herein.

I. gRNA Molecules

A gRNA molecule, as that term is used herein, refers to a nucleic acid that promotes the specific targeting or homing of a gRNA molecule/Cas9 molecule complex to a target nucleic acid. gRNA molecules can be unimolecular (having a single RNA molecule), sometimes referred to herein as "chimeric" gRNAs, or modular (comprising more than one, and typically two, separate RNA molecules). A gRNA molecule comprises a number of domains. The gRNA molecule domains are described in more detail below.

Several exemplary gRNA structures, with domains indicated thereon, are provided in FIG. 1. While not wishing to be bound by theory, with regard to the three dimensional form, or intra- or inter-strand interactions of an active form of a gRNA, regions of high complementarity are sometimes shown as duplexes in FIG. 1 and other depictions provided herein.

In an embodiment, a unimolecular, or chimeric, gRNA comprises, preferably from 5' to 3':
 a targeting domain (which is complementary to a target nucleic acid in the CEP290 gene, e.g., a targeting domain from any of Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10);
 a first complementarity domain;
 a linking domain;
 a second complementarity domain (which is complementary to the first complementarity domain);
 a proximal domain; and
 optionally, a tail domain.

In an embodiment, a modular gRNA comprises:
 a first strand comprising, preferably from 5' to 3';
  a targeting domain (which is complementary to a target nucleic acid in the CEP290 gene, e.g., a targeting domain from Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10); and
  a first complementarity domain; and
 a second strand, comprising, preferably from 5' to 3':
  optionally, a 5' extension domain;
  a second complementarity domain;
  a proximal domain; and
  optionally, a tail domain.

The domains are discussed briefly below:

The Targeting Domain

FIGS. 1A-1G provide examples of the placement of targeting domains.

The targeting domain comprises a nucleotide sequence that is complementary, e.g., at least 80, 85, 90, or 95% complementary, e.g., fully complementary, to the target sequence on the target nucleic acid. The targeting domain is part of an RNA molecule and will therefore comprise the base uracil (U), while any DNA encoding the gRNA molecule will comprise the base thymine (T). While not wishing to be bound by theory, in an embodiment, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence. In an embodiment, the target domain itself comprises in the 5' to 3' direction, an optional secondary domain, and a core domain. In an embodiment, the core domain is fully complementary with the target sequence. In an embodiment, the targeting domain is 5 to 50 nucleotides in length. The strand of the target nucleic acid with which the targeting domain is complementary is referred to herein as the complementary strand. Some or all of the nucleotides of the domain can have a modification, e.g., a modification found in Section VIII herein.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

Targeting domains are discussed in more detail below.

The First Complementarity Domain

FIGS. 1A-1G provide examples of first complementarity domains.

The first complementarity domain is complementary with the second complementarity domain, and in an embodiment, has sufficient complementarity to the second complementarity domain to form a duplexed region under at least some physiological conditions. In an embodiment, the first complementarity domain is 5 to 30 nucleotides in length. In an embodiment, the first complementarity domain is 5 to 25 nucleotides in length. In an embodiment, the first complementary domain is 7 to 25 nucleotides in length. In an embodiment, the first complementary domain is 7 to 22 nucleotides in length. In an embodiment, the first complementary domain is 7 to 18 nucleotides in length. In an embodiment, the first complementary domain is 7 to 15 nucleotides in length. In an embodiment, the first complementary domain is 5, 6, 7, 8, 9, 10, 11, 12, 13, 14, 15, 16, 17, 18, 19, 20, 21, 22, 23, 24, or 25 nucleotides in length.

In an embodiment, the first complimentary domain comprises 3 subdomains, which, in the 5' to 3' direction are: a 5' subdomain, a central subdomain, and a 3' subdomain. In an embodiment, the 5' subdomain is 4-9, e.g., 4, 5, 6, 7, 8 or 9 nucleotides in length. In an embodiment, the central subdomain is 1, 2, or 3, e.g., 1, nucleotide in length. In an embodiment, the 3' subdomain is 3 to 25, e.g., 4-22, 4-18, or 4 to 10, or 3, 4, 5, 6, 7, 8, 9, 10, 11, 12, 13, 14, 15, 16, 17, 18, 19, 20, 21, 22, 23, 24, or 25, nucleotides in length.

The first complementarity domain can share homology with, or be derived from, a naturally occurring first complementarity domain. In an embodiment, it has at least 50% homology with a first complementarity domain disclosed herein, e.g., an *S. pyogenes, S. aureus,* or *S. thermophilus,* first complementarity domain.

Some or all of the nucleotides of the domain can have a modification, e.g., a modification found in Section VIII herein.

First complementarity domains are discussed in more detail below.

The Linking Domain

FIGS. 1A-1G provide examples of linking domains.

A linking domain serves to link the first complementarity domain with the second complementarity domain of a unimolecular gRNA. The linking domain can link the first and second complementarity domains covalently or non-covalently. In an embodiment, the linkage is covalent. In an embodiment, the linking domain covalently couples the first and second complementarity domains, see, e.g., FIGS. 1B-1E. In an embodiment, the linking domain is, or comprises, a covalent bond interposed between the first complementarity domain and the second complementarity domain. Typically the linking domain comprises one or more, e.g., 2, 3, 4, 5, 6, 7, 8, 9, or 10 nucleotides.

In modular gRNA molecules the two molecules are associated by virtue of the hybridization of the complementarity domains see e.g., FIG. 1A.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In an embodiment, a linking domain is 2, 3, 4, 5, 6, 7, 8, 9, 10, 15, 20, or 25 or more nucleotides in length. In an embodiment, a linking domain is 2 to 50, 2 to 40, 2 to 30, 2 to 20, 2 to 10, or 2 to 5 nucleotides in length. In an embodiment, a linking domain shares homology with, or is derived from, a naturally occurring sequence, e.g., the sequence of a tracrRNA that is 5' to the second complementarity domain. In an embodiment, the linking domain has at least 50% homology with a linking domain disclosed herein.

Some or all of the nucleotides of the domain can have a modification, e.g., a modification found in Section VIII herein.

Linking domains are discussed in more detail below.

The 5' Extension Domain

In an embodiment, a modular gRNA can comprise additional sequence, 5' to the second complementarity domain, referred to herein as the 5' extension domain, see, e.g., FIG. 1A. In an embodiment, the 5' extension domain is, 2-10, 2-9, 2-8, 2-7, 2-6, 2-5, or 2-4 nucleotides in length. In an embodiment, the 5' extension domain is 2, 3, 4, 5, 6, 7, 8, 9, or 10 or more nucleotides in length.

The Second Complementarity Domain

FIGS. 1A-1G provide examples of second complementarity domains.

Figure 1B:
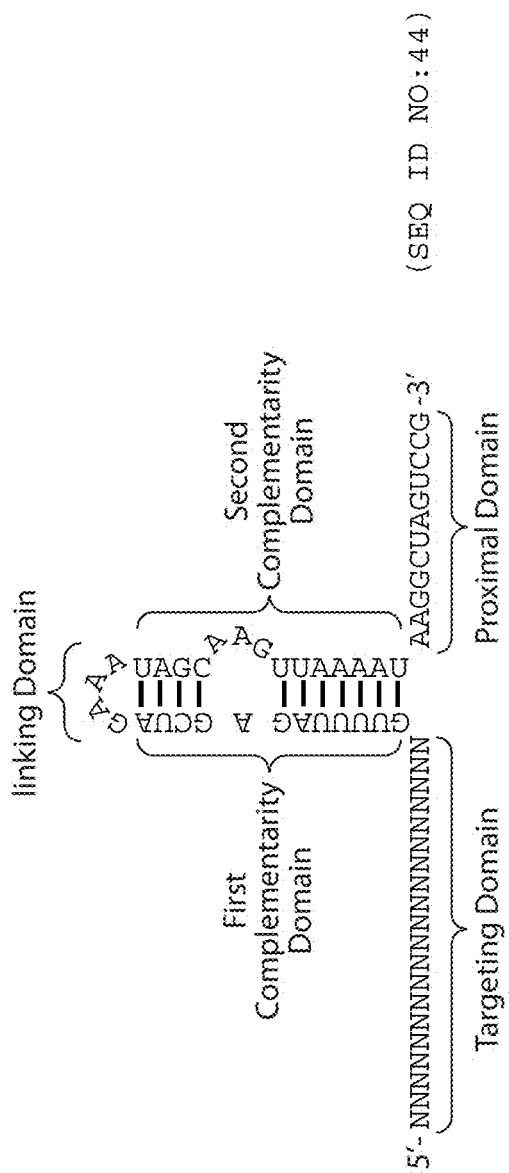
Figure 1C:
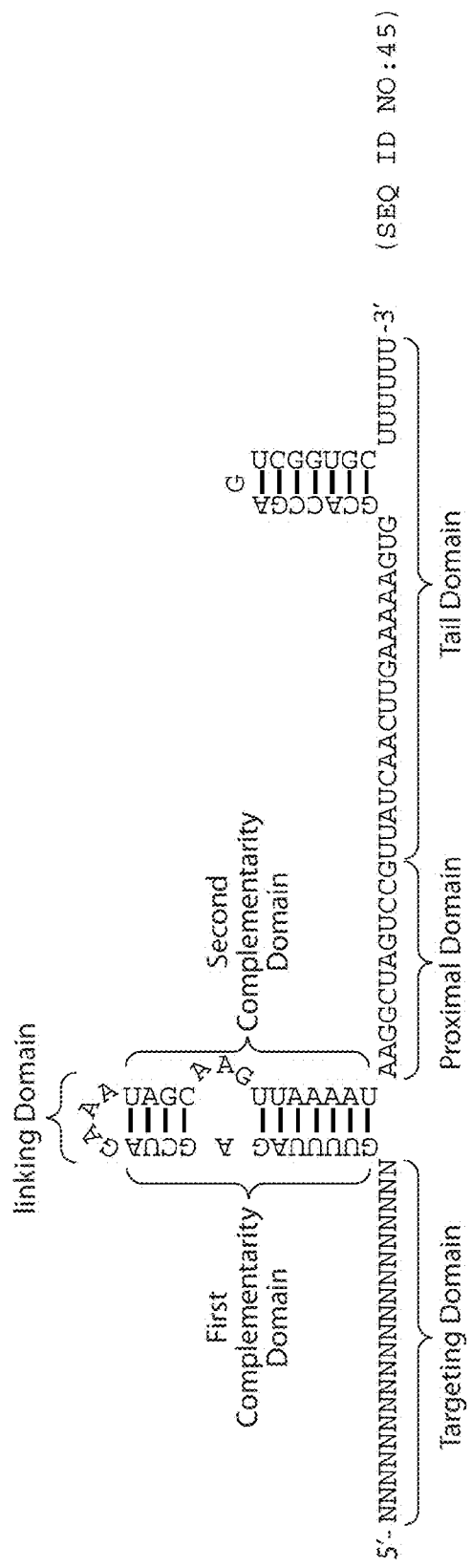
Figure 1D:
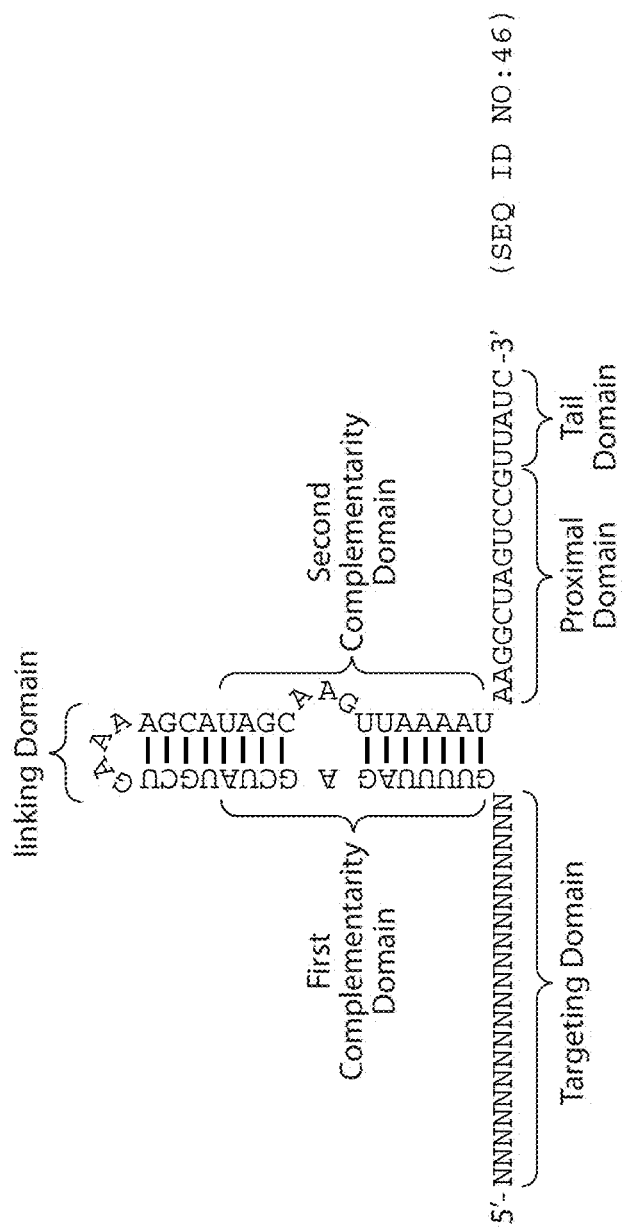
Figure 1E:
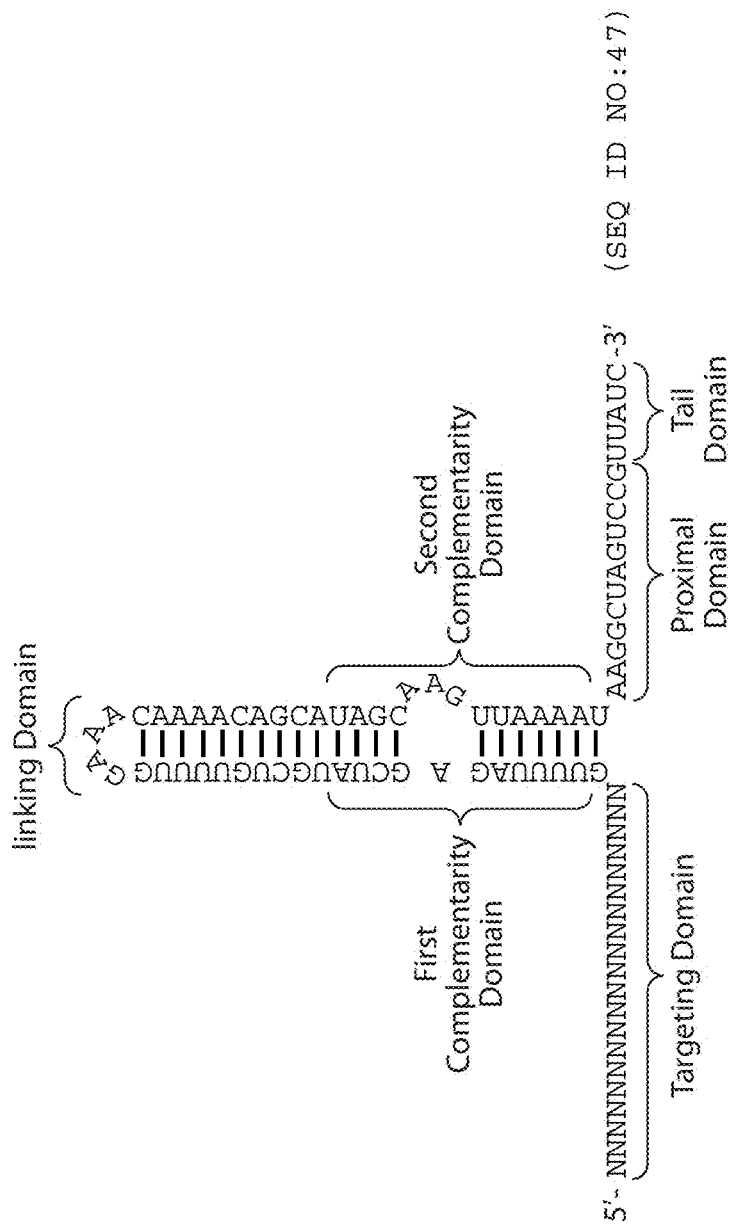

The second complementarity domain is complementary with the first complementarity domain, and in an embodiment, has sufficient complementarity to the second complementarity domain to form a duplexed region under at least some physiological conditions. In an embodiment, e.g., as shown in FIGS. 1A-1B, the second complementarity domain can include sequence that lacks complementarity with the first complementarity domain, e.g., sequence that loops out from the duplexed region.

In an embodiment, the second complementarity domain is 5 to 27 nucleotides in length. In an embodiment, it is longer than the first complementarity region. In an embodiment the second complementary domain is 7 to 27 nucleotides in length. In an embodiment, the second complementary domain is 7 to 25 nucleotides in length. In an embodiment, the second complementary domain is 7 to 20 nucleotides in length. In an embodiment, the second complementary domain is 7 to 17 nucleotides in length. In an embodiment, the complementary domain is 5, 6, 7, 8, 9, 10, 11, 12, 13, 14, 15, 16, 17, 18, 19, 20, 21, 22, 23, 24, 25 or 26 nucleotides in length.

In an embodiment, the second complentarity domain comprises 3 subdomains, which, in the 5' to 3' direction are: a 5' subdomain, a central subdomain, and a 3' subdomain. In an embodiment, the 5' subdomain is 3 to 25, e.g., 4 to 22, 4 to18, or 4 to 10, or 3, 4, 5, 6, 7, 8, 9, 10, 11, 12, 13, 14, 15, 16, 17, 18, 19, 20, 21, 22, 23, 24, or 25 nucleotides in length. In an embodiment, the central subdomain is 1, 2, 3, 4 or 5, e.g., 3, nucleotides in length. In an embodiment, the 3' subdomain is 4 to 9, e.g., 4, 5, 6, 7, 8 or 9 nucleotides in length.

In an embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In an embodiment, it has at least 50% homology with a second complementarity domain disclosed herein, e.g., an *S. pyogenes, S. aureus,* or *S. thermophilus,* first complementarity domain.

Some or all of the nucleotides of the domain can have a modification, e.g., a modification found in Section VIII herein.

A Proximal Domain

FIGS. 1A-1G provide examples of proximal domains.

In an embodiment, the proximal domain is 5 to 20 nucleotides in length. In an embodiment, the proximal domain can share homology with or be derived from a naturally occurring proximal domain. In an embodiment, it has at least 50% homology with a proximal domain disclosed herein, e.g., an *S. pyogenes, S. aureus,* or *S. thermophilus,* proximal domain.

Some or all of the nucleotides of the domain can have a modification, e.g., a modification found in Section VIII herein.

A Tail Domain

FIGS. 1A-1G provide examples of tail domains.

As can be seen by inspection of the tail domains in FIGS. 1A and 1B-1F, a broad spectrum of tail domains are suitable for use in gRNA molecules. In an embodiment, the tail domain is 0 (absent), 1, 2, 3, 4, 5, 6, 7, 8, 9, or 10 nucleotides in length. In embodiment, the tail domain nucleotides are from or share homology with sequence from the 5' end of a naturally occurring tail domain, see e.g., FIG. 1D or 1E. In an embodiment, the tail domain includes sequences that are complementary to each other and which, under at least some physiological conditions, form a duplexed region.

In an embodiment, the tail domain is absent or is 1 to 50 nucleotides in length. In an embodiment, the tail domain can share homology with or be derived from a naturally occurring proximal tail domain. In an embodiment, it has at least 50% homology with a tail domain disclosed herein, e.g., an *S. pyogenes, S. aureus,* or *S. thermophilus,* tail domain.

In an embodiment, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template.

When a U6 promoter is used for in vivo transcription, these nucleotides may be the sequence UUUUUU. When alternate pol-III promoters are used, these nucleotides may be various numbers or uracil bases or may include alternate bases.

The domains of gRNA molecules are described in more detail below.

The Targeting Domain

The "targeting domain" of the gRNA is complementary to the "target domain" on the target nucleic acid. The strand of the target nucleic acid comprising the core domain target is referred to herein as the "complementary strand" of the target nucleic acid. Guidance on the selection of targeting domains can be found, e.g., in Fu Y et al., Nat Biotechnol 2014 (doi: 10.1038/nbt.2808) and Sternberg S H et al., Nature 2014 (doi: 10.1038/nature13011).

In an embodiment, the targeting domain is 16, 17, 18, 19, 20, 21, 22, 23, 24, 25 or 26 nucleotides in length.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, the targeting domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the targeting domain is 20+/−5 nucleotides in length.

In an embodiment, the targeting domain is 20+/−10, 30+/−10, 40+/−10, 50+/−10, 60+/−10, 70+/−10, 80+/−10, 90+/−10, or 100+/−10 nucleotides, in length.

In an embodiment, the targeting domain is 30+/−10 nucleotides in length.

In an embodiment, the targeting domain is 10 to 100, 10 to 90, 10 to 80, 10 to 70, 10 to 60, 10 to 50, 10 to 40, 10 to 30, 10 to 20 or 10 to 15 nucleotides in length. In other embodiments, the targeting domain is 20 to 100, 20 to 90, 20 to 80, 20 to 70, 20 to 60, 20 to 50, 20 to 40, 20 to 30, or 20 to 25 nucleotides in length.

Typically the targeting domain has full complementarity with the target sequence. In some embodiments the targeting domain has or includes 1, 2, 3, 4, 5, 6, 7 or 8 nucleotides that are not complementary with the corresponding nucleotide of the targeting domain.

In an embodiment, the target domain includes 1, 2, 3, 4 or 5 nucleotides that are complementary with the corresponding nucleotide of the targeting domain within 5 nucleotides of its 5' end. In an embodiment, the target domain includes 1, 2, 3, 4 or 5 nucleotides that are complementary with the corresponding nucleotide of the targeting domain within 5 nucleotides of its 3' end.

In an embodiment, the target domain includes 1, 2, 3, or 4 nucleotides that are not complementary with the corresponding nucleotide of the targeting domain within 5 nucleotides of its 5' end. In an embodiment, the target domain includes 1, 2, 3, or 4 nucleotides that are not complementary with the corresponding nucleotide of the targeting domain within 5 nucleotides of its 3' end.

In an embodiment, the degree of complementarity, together with other properties of the gRNA, is sufficient to allow targeting of a Cas9 molecule to the target nucleic acid.

In some embodiments, the targeting domain comprises two consecutive nucleotides that are not complementary to the target domain ("non-complementary nucleotides"), e.g., two consecutive noncomplementary nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides within 5 nucleotides of the 5' end of the targeting domain, within 5 nucleotides of the 3' end of the targeting domain, or within a region that is more than 5 nucleotides away from one or both ends of the targeting domain, are not complementary to the targeting domain.

In an embodiment, there are no noncomplementary nucleotides within 5 nucleotides of the 5' end of the targeting domain, within 5 nucleotides of the 3' end of the targeting domain, or within a region that is more than 5 nucleotides away from one or both ends of the targeting domain.

In an embodiment, the targeting domain nucleotides do not comprise modifications, e.g., modifications of the type provided in Section VIII. However, in an embodiment, the targeting domain comprises one or more modifications, e.g., modifications that it render it less susceptible to degradation or more bio-compatible, e.g., less immunogenic. By way of example, the backbone of the targeting domain can be modified with a phosphorothioate, or other modification(s) from Section VIII. In an embodiment, a nucleotide of the targeting domain can comprise a 2' modification, e.g., a 2-acetylation, e.g., a 2' methylation, or other modification(s) from Section VIII.

In some embodiments, the targeting domain includes 1, 2, 3, 4, 5, 6, 7 or 8 or more modifications. In an embodiment, the targeting domain includes 1, 2, 3, or 4 modifications within 5 nucleotides of its 5' end. In an embodiment, the targeting domain comprises as many as 1, 2, 3, or 4 modifications within 5 nucleotides of its 3' end.

In some embodiments, the targeting domain comprises modifications at two consecutive nucleotides, e.g., two consecutive nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides are modified within 5 nucleotides of the 5' end of the targeting domain, within 5 nucleotides of the 3' end of the targeting domain, or within a region that is more than 5 nucleotides away from one or both ends of the targeting domain. In an embodiment, no nucleotide is modified within 5 nucleotides of the 5' end of the targeting domain, within 5 nucleotides of the 3' end of the targeting domain, or within a region that is more than 5 nucleotides away from one or both ends of the targeting domain.

Modifications in the targeting domain can be selected to not interfere with targeting efficacy, which can be evaluated by testing a candidate modification in the system described in Section IV gRNA's having a candidate targeting domain having a selected length, sequence, degree of complementarity, or degree of modification, can be evaluated in a system in Section IV. The candidate targeting domain can be placed, either alone, or with one or more other candidate changes in a gRNA molecule/Cas9 molecule system known to be functional with a selected target and evaluated.

In some embodiments, all of the modified nucleotides are complementary to and capable of hybridizing to corresponding nucleotides present in the target domain. In other embodiments, 1, 2, 3, 4, 5, 6, 7 or 8 or more modified nucleotides are not complementary to or capable of hybridizing to corresponding nucleotides present in the target domain.

In an embodiment, the targeting domain comprises, preferably in the 5'→3' direction: a secondary domain and a core domain. These domains are discussed in more detail below.

The Core Domain and Secondary Domain of the Targeting Domain

The "core domain" of the targeting domain is complementary to the "core domain target" on the target nucleic acid. In an embodiment, the core domain comprises about 8 to about 13 nucleotides from the 3' end of the targeting domain (e.g., the most 3' 8 to 13 nucleotides of the targeting domain).

In an embodiment, the secondary domain is absent or optional.

In an embodiment, the core domain and targeting domain, are independently, 6+/−2, 7+/−2, 8+/−2, 9+/−2, 10+/−2, 11+/−2, 12+/−2, 13+/−2, 14+/−2, 15+/−2, 16+−2, 17+/−2, or 18+/−2, nucleotides in length.

In an embodiment, the core domain and targeting domain, are independently, 10+/−2 nucleotides in length.

In an embodiment, the core domain and targeting domain, are independently, 10+/−4 nucleotides in length.

In an embodiment, the core domain and targeting domain, are independently, 6, 7, 8, 9, 10, 11, 12, 13, 14, 15, 16, 17, or 18, nucleotides in length.

In an embodiment, the core domain and targeting domain, are independently 3 to 20, 4 to 20, 5 to 20, 6 to 20, 7 to 20, 8 to 20, 9 to 20 10 to 20 or 15 to 20 nucleotides in length.

In an embodiment, the core domain and targeting domain, are independently 3 to 15, e.g., 6 to 15, 7 to 14, 7 to 13, 6 to 12, 7 to 12, 7 to 11, 7 to 10, 8 to 14, 8 to 13, 8 to 12, 8 to 11, 8 to 10 or 8 to 9 nucleotides in length.

The core domain is complementary with the core domain target. Typically the core domain has exact complementarity with the core domain target. In some embodiments, the core domain can have 1, 2, 3, 4 or 5 nucleotides that are not complementary with the corresponding nucleotide of the core domain. In an embodiment, the degree of complementarity, together with other properties of the gRNA, is sufficient to allow targeting of a Cas9 molecule to the target nucleic acid.

The "secondary domain" of the targeting domain of the gRNA is complementary to the "secondary domain target" of the target nucleic acid.

In an embodiment, the secondary domain is positioned 5' to the core domain.

In an embodiment, the secondary domain is absent or optional.

In an embodiment, if the targeting domain is 26 nucleotides in length and the core domain (counted from the 3' end of the targeting domain) is 8 to 13 nucleotides in length, the secondary domain is 12 to 17 nucleotides in length.

In an embodiment, if the targeting domain is 25 nucleotides in length and the core domain (counted from the 3' end of the targeting domain) is 8 to 13 nucleotides in length, the secondary domain is 12 to 17 nucleotides in length.

In an embodiment, if the targeting domain is 24 nucleotides in length and the core domain (counted from the 3' end of the targeting domain) is 8 to 13 nucleotides in length, the secondary domain is 11 to 16 nucleotides in length.

In an embodiment, if the targeting domain is 23 nucleotides in length and the core domain (counted from the 3' end of the targeting domain) is 8 to 13 nucleotides in length, the secondary domain is 10 to 15 nucleotides in length.

In an embodiment, if the targeting domain is 22 nucleotides in length and the core domain (counted from the 3' end of the targeting domain) is 8 to 13 nucleotides in length, the secondary domain is 9 to 14 nucleotides in length.

In an embodiment, if the targeting domain is 21 nucleotides in length and the core domain (counted from the 3' end of the targeting domain) is 8 to 13 nucleotides in length, the secondary domain is 8 to 13 nucleotides in length.

In an embodiment, if the targeting domain is 20 nucleotides in length and the core domain (counted from the 3' end of the targeting domain) is 8 to 13 nucleotides in length, the secondary domain is 7 to 12 nucleotides in length.

In an embodiment, if the targeting domain is 19 nucleotides in length and the core domain (counted from the 3' end of the targeting domain) is 8 to 13 nucleotides in length, the secondary domain is 6 to 11 nucleotides in length.

In an embodiment, if the targeting domain is 18 nucleotides in length and the core domain (counted from the 3' end of the targeting domain) is 8 to 13 nucleotides in length, the secondary domain is 5 to 10 nucleotides in length.

In an embodiment, if the targeting domain is 17 nucleotides in length and the core domain (counted from the 3' end of the targeting domain) is 8 to 13 nucleotides in length, the secondary domain is 4 to 9 nucleotides in length.

In an embodiment, if the targeting domain is 16 nucleotides in length and the core domain (counted from the 3' end of the targeting domain) is 8 to 13 nucleotides in length, the secondary domain is 3 to 8 nucleotides in length.

In an embodiment, the secondary domain is 0, 1, 2, 3, 4, 5, 6, 7, 8, 9, 10, 11, 12, 13, 14 or 15 nucleotides in length.

The secondary domain is complementary with the secondary domain target. Typically the secondary domain has exact complementarity with the secondary domain target. In some embodiments the secondary domain can have 1, 2, 3, 4 or 5 nucleotides that are not complementary with the corresponding nucleotide of the secondary domain. In an embodiment, the degree of complementarity, together with other properties of the gRNA, is sufficient to allow targeting of a Cas9 molecule to the target nucleic acid.

In an embodiment, the core domain nucleotides do not comprise modifications, e.g., modifications of the type provided in Section VIII. However, in an embodiment, the core domain comprise one or more modifications, e.g., modifications that it render it less susceptible to degradation or more bio-compatible, e.g., less immunogenic. By way of example, the backbone of the core domain can be modified with a phosphorothioate, or other modification(s) from Section VIII. In an embodiment a nucleotide of the core domain can comprise a 2' modification, e.g., a 2-acetylation, e.g., a 2' methylation, or other modification(s) from Section VIII. Typically, a core domain will contain no more than 1, 2, or 3 modifications.

Modifications in the core domain can be selected to not interfere with targeting efficacy, which can be evaluated by testing a candidate modification in the system described in Section IV. gRNA's having a candidate core domain having a selected length, sequence, degree of complementarity, or degree of modification, can be evaluated in the system described at Section IV. The candidate core domain can be placed, either alone, or with one or more other candidate changes in a gRNA molecule/Cas9 molecule system known to be functional with a selected target and evaluated.

In an embodiment, the secondary domain nucleotides do not comprise modifications, e.g., modifications of the type provided in Section VIII. However, in an embodiment, the secondary domain comprises one or more modifications, e.g., modifications that it render it less susceptible to degradation or more bio-compatible, e.g., less immunogenic. By way of example, the backbone of the secondary domain can be modified with a phosphorothioate, or other modification(s) from Section VIII. In an embodiment a nucleotide of the secondary domain can comprise a 2' modification, e.g., a 2-acetylation, e.g., a 2' methylation, or other modification(s) from Section VIII. Typically, a secondary domain will contain no more than 1, 2, or 3 modifications.

Modifications in the secondary domain can be selected to not interfere with targeting efficacy, which can be evaluated by testing a candidate modification in the system described in Section IV. gRNA's having a candidate secondary domain having a selected length, sequence, degree of complementarity, or degree of modification, can be evaluated in the system described at Section IV. The candidate secondary domain can be placed, either alone, or with one or more other candidate changes in a gRNA molecule/Cas9 molecule system known to be functional with a selected target and evaluated.

In an embodiment, (1) the degree of complementarity between the core domain and its target, and (2) the degree of complementarity between the secondary domain and its target, may differ. In an embodiment, (1) may be greater (2). In an embodiment, (1) may be less than (2). In an embodiment, (1) and (2) are the same, e.g., each may be completely complementary with its target.

In an embodiment, (1) the number of modification (e.g., modifications from Section VIII) of the nucleotides of the core domain and (2) the number of modification (e.g., modifications from Section VIII) of the nucleotides of the secondary domain, may differ. In an embodiment, (1) may be less than (2). In an embodiment, (1) may be greater than (2). In an embodiment, (1) and (2) may be the same, e.g., each may be free of modifications.

The First and Second Complementarity Domains

The first complementarity domain is complementary with the second complementarity domain.

Typically the first domain does not have exact complementarity with the second complementarity domain target. In some embodiments, the first complementarity domain can have 1, 2, 3, 4 or 5 nucleotides that are not complementary with the corresponding nucleotide of the second complementarity domain. In an embodiment, 1, 2, 3, 4, 5 or 6, e.g., 3 nucleotides, will not pair in the duplex, and, e.g., form a non-duplexed or looped-out region. In an embodiment, an unpaired, or loop-out, region, e.g., a loop-out of 3 nucleotides, is present on the second complementarity domain. In an embodiment, the unpaired region begins 1, 2, 3, 4, 5, or 6, e.g., 4, nucleotides from the 5' end of the second complementarity domain.

In an embodiment, the degree of complementarity, together with other properties of the gRNA, is sufficient to allow targeting of a Cas9 molecule to the target nucleic acid.

In an embodiment, the first and second complementarity domains are:

independently, 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length;

independently, 6, 7, 8, 9, 10, 11, 12, 13, 14, 14, 16, 17, 18, 19, 20, 21, 22, 23, 24, 25, or 26, nucleotides in length; or independently, 5 to 24, 5 to 23, 5 to 22, 5 to 21, 5 to 20, 7 to 18, 9 to 16, or 10 to 14 nucleotides in length.

In an embodiment, the second complementarity domain is longer than the first complementarity domain, e.g., 2, 3, 4, 5, or 6, e.g., 6, nucleotides longer.

In an embodiment, the first and second complementary domains, independently, do not comprise modifications, e.g., modifications of the type provided in Section VIII.

In an embodiment, the first and second complementary domains, independently, comprise one or more modifications, e.g., modifications that the render the domain less susceptible to degradation or more bio-compatible, e.g., less immunogenic. By way of example, the backbone of the domain can be modified with a phosphorothioate, or other modification(s) from Section VIII. In an embodiment a nucleotide of the domain can comprise a 2' modification, e.g., a 2-acetylation, e.g., a 2' methylation, or other modification(s) from Section VIII.

In an embodiment, the first and second complementary domains, independently, include 1, 2, 3, 4, 5, 6, 7 or 8 or more modifications. In an embodiment, the first and second complementary domains, independently, include 1, 2, 3, or 4 modifications within 5 nucleotides of its 5' end. In an embodiment, the first and second complementary domains, independently, include as many as 1, 2, 3, or 4 modifications within 5 nucleotides of its 3' end.

In an embodiment, the first and second complementary domains, independently, include modifications at two consecutive nucleotides, e.g., two consecutive nucleotides that are within 5 nucleotides of the 5' end of the domain, within 5 nucleotides of the 3' end of the domain, or more than 5 nucleotides away from one or both ends of the domain. In an embodiment, the first and second complementary domains, independently, include no two consecutive nucleotides that are modified, within 5 nucleotides of the 5' end of the domain, within 5 nucleotides of the 3' end of the domain, or within a region that is more than 5 nucleotides away from one or both ends of the domain. In an embodiment, the first and second complementary domains, independently, include no nucleotide that is modified within 5 nucleotides of the 5' end of the domain, within 5 nucleotides of the 3' end of the domain, or within a region that is more than 5 nucleotides away from one or both ends of the domain.

Modifications in a complementarity domain can be selected to not interfere with targeting efficacy, which can be evaluated by testing a candidate modification in the system described in Section IV. gRNA's having a candidate complementarity domain having a selected length, sequence, degree of complementarity, or degree of modification, can be evaluated in the system described in Section IV. The candidate complementarity domain can be placed, either alone, or with one or more other candidate changes in a gRNA molecule/Cas9 molecule system known to be functional with a selected target and evaluated.

In an embodiment, the first complementarity domain has at least 60, 70, 80, 85%, 90% or 95% homology with, or differs by no more than 1, 2, 3, 4, 5, or 6 nucleotides from, a reference first complementarity domain, e.g., a naturally occurring, e.g., an S. pyogenes, S. aureus, or S. thermophilus, first complementarity domain, or a first complementarity domain described herein, e.g., from FIGS. 1A-1G.

In an embodiment, the second complementarity domain has at least 60, 70, 80, 85%, 90%, or 95% homology with, or differs by no more than 1, 2, 3, 4, 5, or 6 nucleotides from, a reference second complementarity domain, e.g., a naturally occurring, e.g., an S. pyogenes, S. aureus, or S. thermophilus, second complementarity domain, or a second complementarity domain described herein, e.g., from FIG. 1A-1G.

The duplexed region formed by first and second complementarity domains is typically 6, 7, 8, 9, 10, 11, 12, 13, 14, 15, 16, 17, 18, 19, 20, 21 or 22 base pairs in length (excluding any looped out or unpaired nucleotides).

In some embodiments, the first and second complementarity domains, when duplexed, comprise 11 paired nucleotides, for example in the gRNA sequence (one paired strand underlined, one bolded):

(SEQ ID NO: 5)
NNNNNNNNNNNNNNNNNNNNNGUUUUAGAGCUAGAAAUAGCAAGUUAAAA

UAAGGCUAGUCCGUUAUCAACUUGAAAAAGUGGCACCGAGUCGGUGC.

In some embodiments, the first and second complementarity domains, when duplexed, comprise 15 paired nucleotides, for example in the gRNA sequence (one paired strand underlined, one bolded):

(SEQ ID NO: 27)
NNNNNNNNNNNNNNNNNNNNNGUUUUAGAGCUAUGCUGAAAAGCAUAGCA

AGUUAAAAUAAGGCUAGUCCGUUAUCAACUUGAAAAAGUGGCACCGAGUC

GGUGC.

In some embodiments the first and second complementarity domains, when duplexed, comprise 16 paired nucleotides, for example in the gRNA sequence (one paired strand underlined, one bolded):

(SEQ ID NO: 28)
NNNNNNNNNNNNNNNNNNNNNGUUUUAGAGCUAUGCUGGAAACAGCAUAG

CAAGUUAAAAUAAGGCUAGUCCGUUAUCAACUUGAAAAAGUGGCACCGAG

UCGGUGC.

In some embodiments the first and second complementarity domains, when duplexed, comprise 21 paired nucleotides, for example in the gRNA sequence (one paired strand underlined, one bolded):

(SEQ ID NO: 29)
NNNNNNNNNNNNNNNNNNNNNGUUUUAGAGCUAUGCUGUUUUGGAAACAAA

ACAGCAUAGCAAGUUAAAAUAAGGCUAGUCCGUUAUCAACUUGAAAAAGU

GGCACCGAGUCGGUGC.

In some embodiments, nucleotides are exchanged to remove poly-U tracts, for example in the gRNA sequences (exchanged nucleotides underlined):

(SEQ ID NO: 30)
NNNNNNNNNNNNNNNNNNNNNGUAUUAGAGCUAGAAAUAGCAAGUUAAUAU

AAGGCUAGUCCGUUAUCAACUUGAAAAAGUGGCACCGAGUCGGUGC;

(SEQ ID NO: 31)
NNNNNNNNNNNNNNNNNNNNNGUUUAAGAGCUAGAAAUAGCAAGUUUAAAU

AAGGCUAGUCCGUUAUCAACUUGAAAAAGUGGCACCGAGUCGGUGC;
and (SEQ ID NO: 32)
NNNNNNNNNNNNNNNNNNNNNGUAUUAGAGCUAUGCUGUAUUGGAAACAAU

ACAGCAUAGCAAGUUAAUAUAAGGCUAGUCCGUUAUCAACUUGAAAAAGU

GGCACCGAGUCGGUGC.

The 5' Extension Domain

In an embodiment, a modular gRNA can comprise additional sequence, 5' to the second complementarity domain. In an embodiment, the 5' extension domain is 2 to 10, 2 to 9, 2 to 8, 2 to 7, 2 to 6, 2 to 5, or 2 to 4 nucleotides in length. In an embodiment, the 5' extension domain is 2, 3, 4, 5, 6, 7, 8, 9, or 10 or more nucleotides in length.

In an embodiment, the 5' extension domain nucleotides do not comprise modifications, e.g., modifications of the type provided in Section VIII. However, in an embodiment, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) from Section VIII. In an embodiment, a nucleotide of the 5' extension domain can comprise a 2' modification, e.g., a 2-acetylation, e.g., a 2' methylation, or other modification(s) from Section VIII.

In some embodiments, the 5' extension domain can comprise as many as 1, 2, 3, 4, 5, 6, 7 or 8 modifications. In an embodiment, the 5' extension domain comprises as many as 1, 2, 3, or 4 modifications within 5 nucleotides of its 5' end, e.g., in a modular gRNA molecule. In an embodiment, the 5' extension domain comprises as many as 1, 2, 3, or 4 modifications within 5 nucleotides of its 3' end, e.g., in a modular gRNA molecule.

In some embodiments, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In an embodiment, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In an embodiment, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected to not interfere with gRNA molecule efficacy, which can be evaluated by testing a candidate modification in the system described in Section IV. gRNA's having a candidate 5' extension domain having a selected length, sequence, degree of complementarity, or degree of modification, can be evaluated in the system described at Section IV. The candidate 5' extension domain can be placed, either alone, or with one or more other candidate changes in a gRNA molecule/Cas9 molecule system known to be functional with a selected target and evaluated.

In an embodiment, the 5' extension domain has at least 60, 70, 80, 85, 90 or 95% homology with, or differs by no more than 1, 2, 3, 4, 5, or 6 nucleotides from, a reference 5' extension domain, e.g., a naturally occurring, e.g., an *S. pyogenes, S. aureus,* or *S. thermophilus,* 5' extension domain, or a 5' extension domain described herein, e.g., from FIGS. 1A-1G.

The Linking Domain

In a unimolecular gRNA molecule the linking domain is disposed between the first and second complementarity domains. In a modular gRNA molecule, the two molecules are associated with one another by the complementarity domains.

In an embodiment, the linking domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the linking domain is 20+/−10, 30+/−10, 40+/−10, 50+/−10, 60+/−10, 70+/−10, 80+/−10, 90+/−10, or 100+/−10 nucleotides, in length.

In an embodiment, the linking domain is 10 to 100, 10 to 90, 10 to 80, 10 to 70, 10 to 60, 10 to 50, 10 to 40, 10 to 30, 10 to 20 or 10 to 15 nucleotides in length. In other embodiments, the linking domain is 20 to 100, 20 to 90, 20 to 80, 20 to 70, 20 to 60, 20 to 50, 20 to 40, 20 to 30, or 20 to 25 nucleotides in length.

In an embodiment, the linking domain is 1, 2, 3, 4, 5, 6, 7, 8, 9, 10, 11, 12, 13, 14, 15, 16 17, 18, 19, or 20 nucleotides in length.

In an embodiment, the linking domain is a covalent bond.

In an embodiment, the linking domain comprises a duplexed region, typically adjacent to or within 1, 2, or 3 nucleotides of the 3' end of the first complementarity domain and/or the 5-end of the second complementarity domain. In an embodiment, the duplexed region can be 20+/−10 base pairs in length. In an embodiment, the duplexed region can be 10+/−5, 15+/−5, 20+/−5, or 30+/−5 base pairs in length. In an embodiment, the duplexed region can be 1, 2, 3, 4, 5, 6, 7, 8, 9, 10, 11, 12, 13, 14, or 15 base pairs in length.

Typically the sequences forming the duplexed region have exact complementarity with one another, though in some embodiments as many as 1, 2, 3, 4, 5, 6, 7 or 8 nucleotides are not complementary with the corresponding nucleotides.

In an embodiment, the linking domain nucleotides do not comprise modifications, e.g., modifications of the type provided in Section VIII. However, in an embodiment, the linking domain comprises one or more modifications, e.g., modifications that it render it less susceptible to degradation or more bio-compatible, e.g., less immunogenic. By way of example, the backbone of the linking domain can be modified with a phosphorothioate, or other modification(s) from Section VIII. In an embodiment a nucleotide of the linking domain can comprise a 2' modification, e.g., a 2-acetylation, e.g., a 2' methylation, or other modification(s) from Section VIII. In some embodiments, the linking domain can comprise as many as 1, 2, 3, 4, 5, 6, 7 or 8 modifications.

Modifications in a linking domain can be selected to not interfere with targeting efficacy, which can be evaluated by testing a candidate modification in the system described in Section IV. gRNA's having a candidate linking domain having a selected length, sequence, degree of complementarity, or degree of modification, can be evaluated a system described in Section IV.

A candidate linking domain can be placed, either alone, or with one or more other candidate changes in a gRNA molecule/Cas9 molecule system known to be functional with a selected target and evaluated.

In an embodiment, the linking domain has at least 60, 70, 80, 85, 90 or 95% homology with, or differs by no more than 1, 2, 3, 4, 5, or 6 nucleotides from, a reference linking domain, e.g., a linking domain described herein, e.g., from FIGS. 1A-1G.

The Proximal Domain

In an embodiment, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length.

In an embodiment, the proximal domain is 6, 7, 8, 9, 10, 11, 12, 13, 14, 14, 16, 17, 18, 19, or 20 nucleotides in length.

In an embodiment, the proximal domain is 5 to 20, 7, to 18, 9 to 16, or 10 to 14 nucleotides in length.

In an embodiment, the proximal domain nucleotides do not comprise modifications, e.g., modifications of the type provided in Section VIII. However, in an embodiment, the proximal domain comprises one or more modifications, e.g., modifications that it render it less susceptible to degradation or more bio-compatible, e.g., less immunogenic. By way of example, the backbone of the proximal domain can be modified with a phosphorothioate, or other modification(s) from Section VIII. In an embodiment a nucleotide of the proximal domain can comprise a 2' modification, e.g., a 2-acetylation, e.g., a 2' methylation, or other modification(s) from Section VIII.

In some embodiments, the proximal domain can comprise as many as 1, 2, 3, 4, 5, 6, 7 or 8 modifications. In an embodiment, the proximal domain comprises as many as 1, 2, 3, or 4 modifications within 5 nucleotides of its 5' end, e.g., in a modular gRNA molecule. In an embodiment, the target domain comprises as many as 1, 2, 3, or 4 modifications within 5 nucleotides of its 3' end, e.g., in a modular gRNA molecule.

In some embodiments, the proximal domain comprises modifications at two consecutive nucleotides, e.g., two consecutive nucleotides that are within 5 nucleotides of the 5' end of the proximal domain, within 5 nucleotides of the 3' end of the proximal domain, or more than 5 nucleotides away from one or both ends of the proximal domain. In an embodiment, no two consecutive nucleotides are modified within 5 nucleotides of the 5' end of the proximal domain, within 5 nucleotides of the 3' end of the proximal domain, or within a region that is more than 5 nucleotides away from one or both ends of the proximal domain. In an embodiment, no nucleotide is modified within 5 nucleotides of the 5' end of the proximal domain, within 5 nucleotides of the 3' end of the proximal domain, or within a region that is more than 5 nucleotides away from one or both ends of the proximal domain.

Modifications in the proximal domain can be selected to not interfere with gRNA molecule efficacy, which can be evaluated by testing a candidate modification in the system described in Section IV. gRNA's having a candidate proximal domain having a selected length, sequence, degree of complementarity, or degree of modification, can be evaluated in the system described at Section IV. The candidate proximal domain can be placed, either alone, or with one or more other candidate changes in a gRNA molecule/Cas9 molecule system known to be functional with a selected target and evaluated.

In an embodiment, the proximal domain has at least 60, 70, 80, 85 90 or 95% homology with, or differs by no more than 1, 2, 3, 4, 5, or 6 nucleotides from, a reference proximal domain, e.g., a naturally occurring, e.g., an S. pyogenes, S. aureus, or S. thermophilus, proximal domain, or a proximal domain described herein, e.g., from FIGS. 1A-1G.

The Tail Domain

In an embodiment, the tail domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the tail domain is 20+/−5 nucleotides in length.

In an embodiment, the tail domain is 20+/−10, 30+/−10, 40+/−10, 50+/−10, 60+/−10, 70+/−10, 80+/−10, 90+/−10, or 100+/−10 nucleotides, in length.

In an embodiment, the tail domain is 25+/−10 nucleotides in length.

In an embodiment, the tail domain is 10 to 100, 10 to 90, 10 to 80, 10 to 70, 10 to 60, 10 to 50, 10 to 40, 10 to 30, 10 to 20 or 10 to 15 nucleotides in length.

In other embodiments, the tail domain is 20 to 100, 20 to 90, 20 to 80, 20 to 70, 20 to 60, 20 to 50, 20 to 40, 20 to 30, or 20 to 25 nucleotides in length.

In an embodiment, the tail domain is 1 to 20, 1 to 1, 1 to 10, or 1 to 5 nucleotides in length.

In an embodiment, the tail domain nucleotides do not comprise modifications, e.g., modifications of the type provided in Section VIII. However, in an embodiment, the tail domain comprises one or more modifications, e.g., modifications that it render it less susceptible to degradation or more bio-compatible, e.g., less immunogenic. By way of example, the backbone of the tail domain can be modified with a phosphorothioate, or other modification(s) from Section VIII. In an embodiment a nucleotide of the tail domain can comprise a 2' modification, e.g., a 2-acetylation, e.g., a 2' methylation, or other modification(s) from Section VIII.

In some embodiments, the tail domain can have as many as 1, 2, 3, 4, 5, 6, 7 or 8 modifications. In an embodiment, the target domain comprises as many as 1, 2, 3, or 4 modifications within 5 nucleotides of its 5' end. In an embodiment, the target domain comprises as many as 1, 2, 3, or 4 modifications within 5 nucleotides of its 3' end.

In an embodiment, the tail domain comprises a tail duplex domain, which can form a tail duplexed region. In an embodiment, the tail duplexed region can be 3, 4, 5, 6, 7, 8, 9, 10, 11, or 12 base pairs in length. In an embodiment, a further single stranded domain, exists 3' to the tail duplexed domain. In an embodiment, this domain is 3, 4, 5, 6, 7, 8, 9, or 10 nucleotides in length. In an embodiment it is 4 to 6 nucleotides in length.

In an embodiment, the tail domain has at least 60, 70, 80, or 90% homology with, or differs by no more than 1, 2, 3, 4, 5, or 6 nucleotides from, a reference tail domain, e.g., a naturally occurring, e.g., an S. pyogenes, or S. thermophilus, tail domain, or a tail domain described herein, e.g., from FIGS. 1A-1G.

In an embodiment, the proximal and tail domain, taken together comprise the following sequences:

```
                                          (SEQ ID NO: 33)
AAGGCUAGUCCGUUAUCAACUUGAAAAAGUGGCACCGAGUCGGUGCU, (SEQ ID NO: 34)
AAGGCUAGUCCGUUAUCAACUUGAAAAAGUGGCACCGAGUCGGUGGUGC, (SEQ ID NO: 35)
AAGGCUAGUCCGUUAUCAACUUGAAAAAGUGGCACCGAGUCGGUGCGGA
UC, (SEQ ID NO: 36)
AAGGCUAGUCCGUUAUCAACUUGAAAAAGUG, (SEQ ID NO: 37)
AAGGCUAGUCCGUUAUCA,
or (SEQ ID NO: 38)
AAGGCUAGUCCG.
```

In an embodiment, the tail domain comprises the 3' sequence UUUUUU, e.g., if a U6 promoter is used for transcription.

In an embodiment, the tail domain comprises the 3' sequence UUUU, e.g., if an H1 promoter is used for transcription.

In an embodiment, tail domain comprises variable numbers of 3' Us depending, e.g., on the termination signal of the pol-III promoter used.

In an embodiment, the tail domain comprises variable 3' sequence derived from the DNA template if a T7 promoter is used.

In an embodiment, the tail domain comprises variable 3' sequence derived from the DNA template, e.g., if in vitro transcription is used to generate the RNA molecule.

In an embodiment, the tail domain comprises variable 3' sequence derived from the DNA template, e., if a pol-II promoter is used to drive transcription.

Modifications in the tail domain can be selected to not interfere with targeting efficacy, which can be evaluated by testing a candidate modification in the system described in Section IV. gRNAs having a candidate tail domain having a selected length, sequence, degree of complementarity, or degree of modification, can be evaluated in the system described in Section IV. The candidate tail domain can be placed, either alone, or with one or more other candidate changes in a gRNA molecule/Cas9 molecule system known to be functional with a selected target and evaluated.

In some embodiments, the tail domain comprises modifications at two consecutive nucleotides, e.g., two consecutive nucleotides that are within 5 nucleotides of the 5' end of the tail domain, within 5 nucleotides of the 3' end of the tail domain, or more than 5 nucleotides away from one or both ends of the tail domain. In an embodiment, no two consecutive nucleotides are modified within 5 nucleotides of the 5' end of the tail domain, within 5 nucleotides of the 3' end of the tail domain, or within a region that is more than 5 nucleotides away from one or both ends of the tail domain. In an embodiment, no nucleotide is modified within 5 nucleotides of the 5' end of the tail domain, within 5 nucleotides of the 3' end of the tail domain, or within a region that is more than 5 nucleotides away from one or both ends of the tail domain.

In an embodiment a gRNA has the following structure:

5' [targeting domain]-[first complementarity domain]-[linking domain]-[second complementarity domain]-[proximal domain]-[tail domain]-3' wherein, the targeting domain comprises a core domain and optionally a secondary domain, and is 10 to 50 nucleotides in length;

the first complementarity domain is 5 to 25 nucleotides in length and, In an embodiment has at least 50, 60, 70, 80, 85, 90 or 95% homology with a reference first complementarity domain disclosed herein;

the linking domain is 1 to 5 nucleotides in length;

the proximal domain is 5 to 20 nucleotides in length and, in an embodiment has at least 50, 60, 70, 80, 85, 90 or 95% homology with a reference proximal domain disclosed herein; and the tail domain is absent or a nucleotide sequence is 1 to 50 nucleotides in length and, in an embodiment has at least 50, 60, 70, 80, 85, 90 or 95% homology with a reference tail domain disclosed herein.

Exemplary Chimeric gRNAs

In an embodiment, a unimolecular, or chimeric, gRNA comprises, preferably from 5' to 3':

a targeting domain, e.g., comprising 15, 16, 17, 18, 19, 20, 21, 22, 23, 24, 25, or 26 nucleotides (which is complementary to a target nucleic acid);

a first complementarity domain;

a linking domain;

a second complementarity domain (which is complementary to the first complementarity domain);

a proximal domain; and a tail domain, wherein, (a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides. In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides. In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides. In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNNNNNNNNNNNNNNNNGUUUUAGAGCUA-GAAAUAGCAAGUUAAAAUAAGG CUAGUC-CGUUAUCAACUUGAAAAAGUGGCACCGAGUCG-GUGCUUUUUU (SEQ ID NO: 2778). In an embodiment, the unimolecular, or chimeric, gRNA molecule is a *S. pyogenes* gRNA molecule.

In some embodiments, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number: NNNNNNNNNNNNNNNNNNNNGUUUUAGUACU-CUGGAAACAGAAUCUACUAAAAC AAGGCAAAAUGCCGUGUUUAUCUCGUCAACUU-GUUGGCGAGAUUUUUU (SEQ ID NO: 2779). In an embodiment, the unimolecular, or chimeric, gRNA molecule is a *S. aureus* gRNA molecule.

Figure 18A:
FIG. 18A-18B depicts additional exemplary structures of unimolecular gRNA molecules.
Figure 18B:
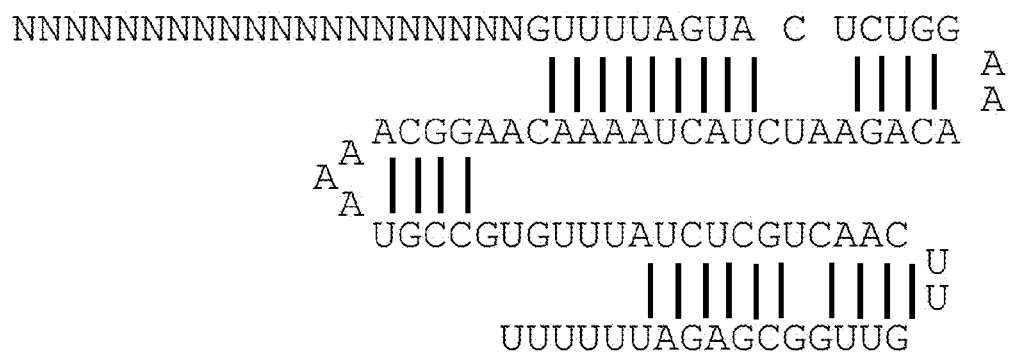
Figure 21F:
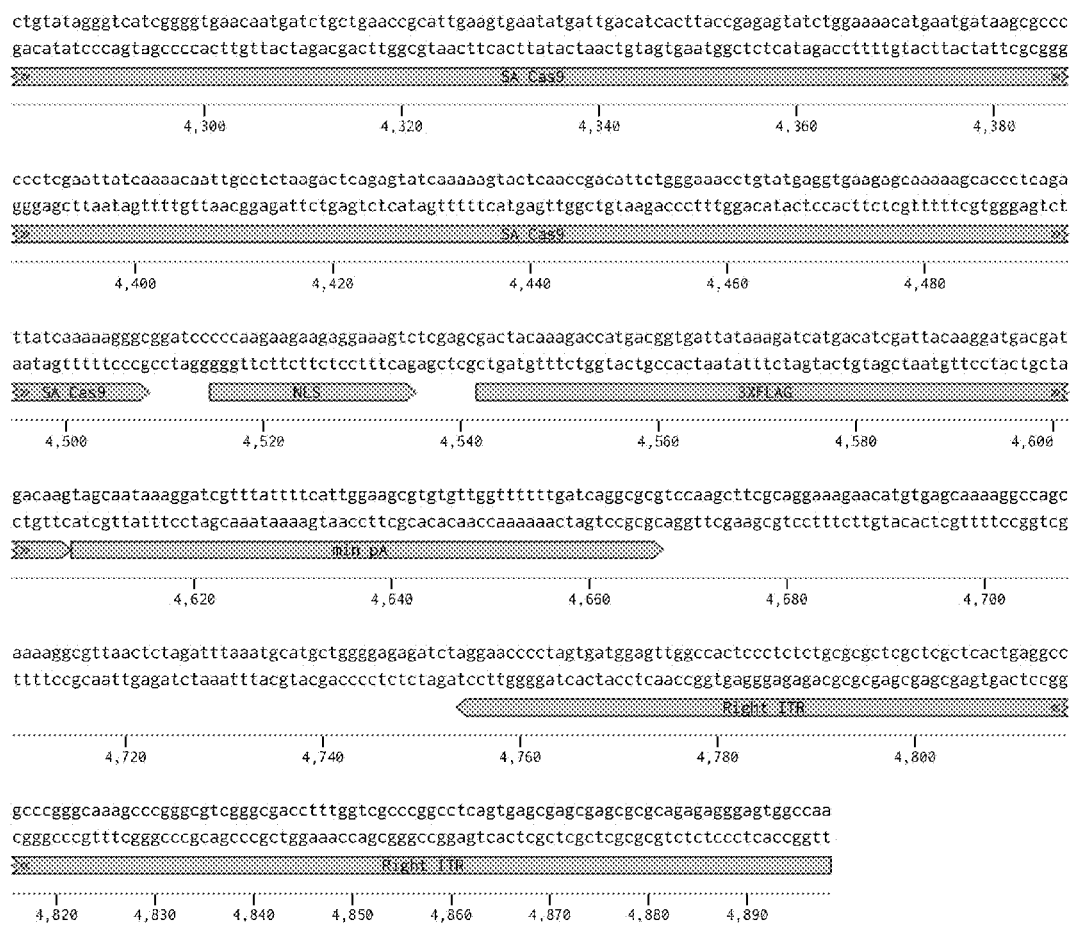
Figure 24A:
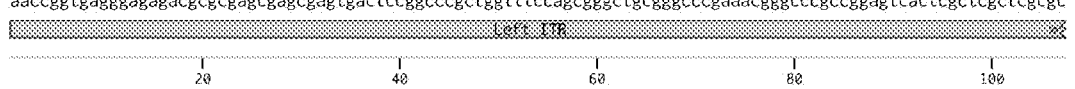

The sequences and structures of exemplary chimeric gRNAs are also shown in FIGS. 18A-18B.

Exemplary Modular gRNAs

In an embodiment, a modular gRNA comprises:
a first strand comprising, preferably from 5' to 3':
  a targeting domain, e.g., comprising 15, 16, 17, 18, 19, 20, 21, 22, 23, 24, 25, or 26 nucleotides;
  a first complementarity domain; and
a second strand, comprising, preferably from 5' to 3':
  optionally a 5' extension domain;
  a second complementarity domain;
  a proximal domain; and
  a tail domain,
wherein:
(a) the proximal and tail domain, when taken together, comprise at least 15, 18, 20, 25, 30, 31, 35, 40, 45, 49, 50, or 53 nucleotides;
(b) there are at least 15, 18, 20, 25, 30, 31, 35, 40, 45, 49, 50, or 53 nucleotides 3' to the last nucleotide of the second complementarity domain; or
(c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

II. Methods for Designing gRNAs

Methods for designing gRNAs are described herein, including methods for selecting, designing and validating target domains. Exemplary targeting domains are also provided herein. Targeting Domains discussed herein can be incorporated into the gRNAs described herein.

Methods for selection and validation of target sequences as well as off-target analyses are described, e.g., in Mali et al., 2013 Science 339(6121): 823-826; Hsu et al. Nat Biotechnol, 31(9): 827-32; Fu et al., 2014 Nat Biotechnol, doi: 10.1038/nbt.2808. PubMed PMID: 24463574; Heigwer et al., 2014 Nat Methods 11(2):122-3. doi: 10.1038/nmeth.2812. PubMed PMID: 24481216; Bae et al., 2014 Bioinformatics PubMed PMID: 24463181; Xiao A et al., 2014 Bioinformatics PubMed PMID: 24389662.

For example, a software tool can be used to optimize the choice of gRNA within a user's target sequence, e.g., to minimize total off-target activity across the genome. Off target activity may be other than cleavage. For each possible gRNA choice using *S. pyogenes* Cas9, software tools can identify all potential off-target sequences (preceding either NAG or NGG PAMs) across the genome that contain up to a certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA can then ranked according to its total predicted off-target cleavage; the top-ranked gRNAs represent those that are likely to have the greatest on-target and the least off-target cleavage. Other functions, e.g., automated reagent design for gRNA vector construction, primer design for the on-target Surveyor assay, and primer design for high-throughput detection and quantification of off-target cleavage via next-generation sequencing, can also be included in the tool. Candidate gRNA molecules can be evaluated by art-known methods or as described in Section IV herein.

Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (Bae et al. Bioinformatics. 2014; 30(10): 1473-1475). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relavant PAM, e.g., in the case of *S. pyogenes*, a NGG PAM, in the case of *S. aureus*, NNGRR (e.g, a NNGRRT or NNGRRV) PAM, and in the case of *N. meningitides*, a NNNNGATT or NNNNGCTT PAM. Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitides* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprises the 17-mer described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, e.g., the targeting domains of 18 or more nucleotides may comprise the 17-mer gRNAs described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. Targeting domains, disclosed herein, may comprises the 18-mer described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, e.g., the targeting domains of 19 or more nucleotides may comprise the 18-mer gRNAs described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. Targeting domains, disclosed herein, may comprises the 19-mer described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, e.g., the targeting domains of 20 or more nucleotides may comprise the 19-mer gRNAs described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. Targeting domains, disclosed herein, may comprises the 20-mer gRNAs described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, e.g., the targeting domains of 21 or more nucleotides may comprise the 20-mer gRNAs described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. Targeting domains, disclosed herein, may comprises the 21-mer described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, e.g., the targeting domains of 22 or more nucleotides may comprise the 21-mer gRNAs described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. Targeting domains, disclosed herein, may comprises the 22-mer described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, e.g., the targeting domains of 23 or more nucleotides may comprise the 22-mer gRNAs described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. Targeting domains, disclosed herein, may comprises the 23-mer described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, e.g., the targeting domains of 24 or more nucleotides may comprise the 23-mer gRNAs described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10. Targeting domains, disclosed herein, may comprises the 24-mer described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10, e.g., the targeting domains of 25 or more nucleotides may comprise the 24-mer gRNAs described in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10.

gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs.

Candidate pair members can be tested for how efficiently they remove the entire sequence versus causing indel mutations at the site of one gRNA.

The Targeting Domains discussed herein can be incorporated into the gRNAs described herein.

Three strategies were utilized to identify gRNAs for use with *S. pyogenes, S. aureus* and *N. meningitidis* Cas9 enzymes.

In one strategy, gRNAs were designed for use with *S. pyogenes* and *S. aureus* Cas9 enzymes to induce an indel mediated by NHEJ in close proximity to or including the LCA10 target position (e.g., c.2991+1655A to G). The gRNAs were identified and ranked into 4 tiers for *S. pyogenes* (Tables 1A-1D). The targeting domain for tier 1 gRNA molecules to be used with *S. pyogenes* Cas9 molecules were selected based on (1) a short distance to the target position, e.g., within 40 bp upstream and 40 bp downstream of the mutation, (2) a high level of orthogonality, and (3) the presence of a 5' G. For selection of tier 2 gRNAs, a short distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The gRNAs were identified and ranked into 4 tiers for *S. aureus*, when the relevant PAM was NNGRR (Tables 2A-2C). The targeting domain for tier 1 gRNA molecules to be used with *S. pyogenes* Cas9 molecules were selected based on (1) a short distance to the target position, e.g., within 40 bp upstream and 40 bp downstream of the mutation, (2) a high level of orthogonality, and (3) the presence of a 5' G. For selection of tier 2 gRNAs, a short distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The gRNAs were identified and ranked into 5 tiers for *S. aureus* when the relevant PAM was NNGRRT or NNGRRV (Tables 6A-6D). The targeting domain for tier 1 gRNA molecules to be used with *S. aureus* Cas9 molecules were selected based on (1) a short distance to the target position, e.g., within 40 bp upstream and 40 bp downstream of the mutation, (2) a high level of orthogonality, (3) the presence of a 5' G and (4) PAM was NNGRRT. For selection of tier 2 gRNAs, a short distance and high orthogonality were required but the presence of a 5'G was not required, and PAM was NNGRRT. Tier 3 uses the same distance restriction and the requirement for a 5'G, but removes the requirement of good orthogonality, and PAM was NNGRRT. Tier 4 uses the same distance restriction but removes the requirement of good orthogonality and the 5'G, ang PAM was NNGRRT. Tier 5 required a short distance to the target position, e.g., within 40 bp upstream and 40 bp downstream of the mutation and PAM was NNGRRV. Note that tiers are non-inclusive (each gRNA is listed only once for the strategy). In certain instances, no gRNA was identified based on the criteria of the particular tier.

In a second strategy, gRNAs were designed for use with *S. pyogenes, S. aureus* and *N. meningitidis* Cas9 molecules to delete a genomic sequence including the mutation at the LCA10 target position (e.g., c.2991+1655A to G), e.g., mediated by NHEJ. The gRNAs were identified and ranked into 4 tiers for *S. pyogenes* (Tables 3A-3D). The targeting domain to be used with *S. pyogenes* Cas9 molecules for tier 1 gRNA molecules were selected based on (1) flanking the mutation without targeting unwanted chromosome elements, such as an Alu repeat, e.g., within 400 bp upstream of an Alu repeat or 700 bp downstream of mutation, (2) a high level of orthogonality, and (3) the presence of a 5' G. For selection of tier 2 gRNAs, a reasonable distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The gRNAs were identified and ranked into 4 tiers for *S. aureus*, when the relevant PAM was NNGRR (Tables 4A-4D). The targeting domain to be used with *S. aureus* Cas9 molecules for tier 1 gRNA molecules were selected based on (1) flanking the mutation without targeting unwanted chromosome elements, such as an Alu repeat, e.g., within 400 bp upstream of an Alu repeat or 700 bp downstream of mutation, (2) a high level of orthogonality, and (3) the presence of a 5' G. For selection of tier 2 gRNAs, a reasonable distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. The gRNAs were identified and ranked into 2 tiers for *N. meningitides* (Tables 5A-5B). The targeting domain to be used with *N. meningitides* Cas9 molecules for tier 1 gRNA molecules were selected based on (1) flanking the mutation without targeting unwanted chromosome elements, such as an Alu repeat, e.g., within 400 bp upstream of an Alu repeat or 700 bp downstream of mutation, (2) a high level of orthogonality, and (3) the presence of a 5' G. For selection of tier 2 gRNAs, a reasonable distance and high orthogonality were required but the presence of a 5'G was not required. Note that tiers are non-inclusive (each gRNA is listed only once for the strategy). In certain instances, no gRNA was identified based on the criteria of the particular tier. In a third strategy, gRNAs were designed for use with *S. pyogenes, S. aureus* and *N. meningitidis* Cas9 molecules to delete a genomic sequence including the mutation at the LCA10 target position (e.g., c.2991+1655A to G), e.g., mediated by NHEJ. The gRNAs were identified and ranked into 4 tiers for *S. pyogenes* (Tables 7A-7D). The targeting domain to be used with *S. pyogenes* Cas9 enzymes for tier 1 gRNA molecules were selected based on (1) flanking the mutation without targeting unwanted chromosome elements, such as an Alu repeat, e.g., within 1000 bp upstream of an Alu repeat or 1000 bp downstream of mutation, (2) a high level of orthogonality, (3) the presence of a 5' G and (4) and PAM was NNGRRT. For selection of tier 2 gRNAs, a reasonable distance and high orthogonality were required but the presence of a 5'G was not required, and PAM was NNGRRT. Tier 3 uses the same distance restriction and the requirement for a 5'G, but removes the requirement of good orthogonality, and PAM was NNGRRT. Tier 4 uses the same distance restriction but removes the requirement of good orthogonality and the 5'G, and PAM was NNGRRT. The gRNAs were identified and ranked into 4 tiers for *S. aureus*, when the relevant PAM was NNGRRT or NNGRRV (Tables 8A-8E). The targeting domain to be used with *S. aureus* Cas9 enzymes for tier 1 gRNA molecules were selected based on (1) flanking the mutation without targeting unwanted chromosome elements, such as an Alu repeat, e.g., within 1000 bp upstream of an Alu repeat or 1000 bp downstream of mutation, (2) a high level of orthogonality, and (3) the presence of a 5' G. For selection of tier 2 gRNAs, a reasonable distance and high orthogonality were required but the presence of a 5'G was not required. Tier 3 uses the same distance restriction and the requirement for a 5'G, but removes the requirement of good orthogonality. Tier 4 uses the same distance restriction but removes the requirement of good orthogonality and the 5'G. Tier 5 used the same distance restriction and PAM was NNGRRV. The gRNAs were identified and ranked into 2 tiers for *N. meningitides* (Tables 9A-9B). The targeting domain to be used with *N. meningitides* Cas9 molecules for tier 1 gRNA molecules were selected based on (1) flanking the mutation without targeting unwanted chromosome elements, such as an Alu repeat, e.g., within 1000 bp upstream of an Alu repeat or 1000 bp downstream of mutation, (2) a high level of orthogonality, and (3) the presence of a 5' G. For selection of tier 2 gRNAs, a reasonable distance and high orthogonality were required but the presence of a 5'G was not required. Note that tiers are non-inclusive (each gRNA is listed only once for the strategy). In certain instances, no gRNA was identified based on the criteria of the particular tier.

In an embodiment, when a single gRNA molecule is used to target a Cas9 nickase to create a single strand break to introduce a break-induced indel in close proximity to or including the LCA10 target position, the gRNA is used to target either upstream of (e.g., within 40 bp upstream of the LCA10 target position), or downstream of (e.g., within 40 bp downstream of the LCA10 target position) in the CEP290 gene.

In an embodiment, when a single gRNA molecule is used to target a Cas9 nuclease to create a double strand break to introduce a break-induced indel in close proximity to or including the LCA10 target position, the gRNA is used to target either upstream of (e.g., within 40 bp upstream of the LCA10 target position), or downstream of (e.g., within 40 bp downstream of the LCA10 target position) in the CEP290 gene.

In an embodiment, dual targeting is used to create two double strand breaks to delete a genomic sequence including the mutation at the LCA10 target position, e.g., mediated by NHEJ. In an embodiment, the first and second gRNAs are used target two Cas9 nucleases to flank, e.g., the first of gRNA is used to target upstream of (e.g., within 400 bp upstream of the Alu repeat, or within 40 bp upstream of the LCA10 target position), and the second gRNA is used to target downstream of (e.g., within 700 bp downstream of the LCA10 target position) in the CEP290 gene.

In an embodiment, dual targeting is used to create a double strand break and a pair of single strand breaks to delete a genomic sequence including the mutation at the LCA10 target position, e.g., mediated by NHEJ. In an embodiment, the first, second and third gRNAs are used to target one Cas9 nuclease and two Cas9 nickases to flank, e.g., the first gRNA that will be used with the Cas9 nuclease is used to target upstream of (e.g., within 400 bp upstream of the Alu repeat, or within 40 bp upstream of the LCA10 target position) or downstream of (e.g., within 700 bp downstream) of the LCA10 target position, and the second and third gRNAs that will be used with the Cas9 nickase pair are used to target the opposite side of the LCA10 target position (e.g., within 400 bp upstream of the Alu repeat, within 40 bp upstream of the LCA10 target position, or within 700 bp downstream of the LCA10 target position) in the CEP290 gene.

In an embodiment, when four gRNAs (e.g., two pairs) are used to target four Cas9 nickases to create four single strand breaks to delete genomic sequence including the mutation at the LCA10 target position, e.g., mediated by NHEJ, the first pair and second pair of gRNAs are used to target four Cas9 nickases to flank, e.g., the first pair of gRNAs are used to target upstream of (e.g., within 400 bp upstream of the Alu repeat, or within 40 bp upstream of the LCA10 target position), and the second pair of gRNAs are used to target downstream of (e.g., within 700 bp downstream of the LCA10 target position) in the CEP290 gene.

In an embodiment, dual targeting is utilized to delete genomic sequence including the mutation at the LCA10 target position mediated by NHEJ. It is contemplated herein that in an embodiment any upstream gRNA (e.g., within 400 bp upstream of an Alu repeat, or within 40 bp upstream of the LCA10 target position) in Tables 1A-1C and Tables 3A-3D can be paired with any downstream gRNA (e.g., within 700 downstream of LCA10 target position) in Tables 3A-3D to be used with a *S. pyogenes* Cas9 molecule to generate dual targeting. Exemplary pairs including selecting a targeting domain that is labeled as upstream from Tables 1A-1C or Tables 3A-3D and a second targeting domain that is labeled as downstream from Tables 3A-3D. In an embodiment, a targeting domain that is labeled as upstream in Tables 1A-1C or Tables 3A-3D can be combined with any of the targeting domains that is labeled as downstream in Tables 3A-3D.

In an embodiment, dual targeting is utilized to delete genomic sequence including the mutation at the LCA10 target position mediated by NHEJ. It is contemplated herein that in an embodiment any upstream gRNA (e.g., within 400 bp upstream of an Alu repeat, or within 40 bp upstream of the LCA10 target position) in Tables 2A-2C and Tables 4A-4D can be paired with any downstream gRNA (e.g., within 700 downstream of LCA10 target position) in Tables 4A-4D to be used with a *S. aureus* Cas9 molecule to generate dual targeting. Exemplary pairs include selecting a targeting domain that is labeled as upstream from Tables 2A-2C or Tables 4A-4D and a second targeting domain that is labeled as downstream from Tables 4A-4D. In an embodiment, a targeting domain that is labeled as upstream in Tables 2A-2C or Tables 4A-4D can be combined with any of the targeting domains that is labeled as downstream in Tables 4A-4D.

In an embodiment, dual targeting is utilized to delete genomic sequence including the mutation at the LCA10 target position mediated by NHEJ. It is contemplated herein that in an embodiment any upstream gRNA (e.g., within 400 bp upstream of an Alu repeat, or within 40 bp upstream of the LCA10 target position) in Tables 5A-5B can be paired with any downstream gRNA (e.g., within 700 downstream of LCA10 target position) in Tables 5A-5B to be used with a *N. meningitidis* Cas9 molecule to generate dual targeting. Exemplary pairs include selecting a targeting domain that is labeled as upstream from Tables 5A-5B and a second targeting domain that is labeled as downstream from Tables 5A-5B. In an embodiment, a targeting domain that is labeled as upstream in Tables 5A-5B can be combined with any of the targeting domains that is labeled as downstream in Tables 5A-5B.

In an embodiment, dual targeting (e.g., dual double strand cleavage) is used to create two double strand breaks to delete a genomic sequence including the mutation at the LCA10 target position, e.g., mediated by NHEJ. In an embodiment, the first and second gRNAs are used target two Cas9 nucleases to flank, e.g., the first of gRNA is used to target upstream of (e.g., within 1000 bp upstream of the Alu repeat, or within 40 bp upstream of the LCA10 target position), and the second gRNA is used to target downstream of (e.g., within 1000 bp downstream of the LCA10 target position) in the CEP290 gene.

In an embodiment, dual targeting (e.g., dual double strand cleavage) is used to create a double strand break and a pair of single strand breaks to delete a genomic sequence including the mutation at the LCA10 target position, e.g., mediated by NHEJ. In an embodiment, the first, second and third gRNAs are used to target one Cas9 nuclease and two Cas9 nickases to flank, e.g., the first gRNA that will be used with the Cas9 nuclease is used to target upstream of (e.g., within 1000 bp upstream of the Alu repeat, or within 40 bp upstream of the LCA10 target position) or downstream of (e.g., within 1000 bp downstream) of the LCA10 target position, and the second and third gRNAs that will be used with the Cas9 nickase pair are used to target the opposite side of the LCA10 target position (e.g., within 1000 bp upstream of the Alu repeat, or within 40 bp upstream of the LCA10 target position or within 1000 bp downstream of the LCA10 target position) in the CEP290 gene.

In an embodiment, when four gRNAs (e.g., two pairs) are used to target four Cas9 nickases to create four single strand breaks to delete genomic sequence including the mutation at the LCA10 target position, e.g., mediated by NHEJ, the first pair and second pair of gRNAs are used to target four Cas9 nickases to flank, e.g., the first pair of gRNAs are used to target upstream of (e.g., within 1000 bp upstream of the Alu repeat, or within 40 bp upstream of the LCA10 target position), and the second pair of gRNAs are used to target downstream of (e.g., within 1000 bp downstream of the LCA10 target position) in the CEP290 gene.

In an embodiment, dual targeting is utilized to delete genomic sequence including the mutation at the LCA10 target position, e.g., mediated by NHEJ. It is contemplated herein that in an embodiment any upstream gRNA (e.g., within 1000 bp upstream of an Alu repeat, or within 40 bp upstream of the LCA10 target position) in Tables 1A-1C, Tables 3A-3D, or Tables 7A-7D can be paired with any downstream gRNA (e.g., within 1000 downstream of LCA10 target position) in Tables 1A-1C, Tables 3A-3D, or Tables 7A-7D to be used with a *S. pyogenes* Cas9 molecule to generate dual targeting. Exemplary pairs including selecting a targeting domain that is labeled as upstream from Tables 1A-1C, Tables 3A-3D, or Tables 7A-7D and a second targeting domain that is labeled as downstream from Tables 1A-1C, Tables 3A-3D, or Tables 7A-7D. In an embodiment, a targeting domain that is labeled as upstream in Tables 1A-1C, Tables 3A-3D, or Tables 7A-7D can be combined with any of the targeting domains that is labeled as downstream in Tables 1A-1C, Tables 3A-3D, or Tables 7A-7D.

In an embodiment, dual targeting is utilized to delete genomic sequence including the mutation at the LCA10 target position mediated by NHEJ. It is contemplated herein that in an embodiment any upstream gRNA (e.g., within 1000 bp upstream of an Alu repeat, or within 40 bp upstream of the LCA10 target position) in Tables 2A-2C, Tables 4A-4D, Tables 6A-6D, or Tables 8A-8E can be paired with any downstream gRNA (e.g., within 1000 downstream of LCA10 target position) in Tables 2A-2C, Tables 4A-4D, Tables 6A-6D, or Tables 8A-8E to be used with a *S. aureus* Cas9 molecule to generate dual targeting. Exemplary pairs include selecting a targeting domain that is labeled as upstream from Tables 2A-2C, Tables 4A-4D, Tables 6A-6D, or Tables 8A-8E and a second targeting domain that is labeled as downstream from Tables 2A-2C, Tables 4A-4D, Tables 6A-6D, or Tables 8A-8E. In an embodiment, a targeting domain that is labeled as upstream in Tables 2A-2C, Tables 4A-4D, Tables 6A-6D, or Tables 8A-8E can be combined with any of the targeting domains that is labeled as downstream in Tables 2A-2C, Tables 4A-4D, Tables 6A-6D, or Tables 8A-8E.

In an embodiment, dual targeting is utilized to delete genomic sequence including the mutation at the LCA10 target position, e.g., mediated by NHEJ. It is contemplated herein that in an embodiment any upstream gRNA (e.g., within 1000 bp upstream of an Alu repeat, or within 40 bp upstream of the LCA10 target position) in Tables 5A-5B or Tables 9A-9B can be paired with any downstream gRNA (e.g., within 1000 downstream of LCA10 target position) in Tables 5A-5D to be used with a N. meningitidis Cas9 molecule to generate dual targeting. Exemplary pairs include selecting a targeting domain that is labeled as upstream from Tables 5A-5B or Tables 9A-9B and a second targeting domain that is labeled as downstream from Tables 5A-5B or Tables 9A-9B. In an embodiment, a targeting domain that is labeled as upstream in Tables 5A-5B or Tables 9A-9B and can be combined with any of the targeting domains that is labeled as downstream in Tables 5A-5B or Tables 9A-9B.

Any of the targeting domains in the tables described herein can be used with a Cas9 nickase molecule to generate a single strand break.

Any of the targeting domains in the tables described herein can be used with a Cas9 nuclease molecule to generate a double strand break.

In an embodiment, dual targeting (e.g., dual nicking) is used to create two nicks on opposite DNA strands by using S. pyogenes, S. aureus and N. meningitidis Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp. Exemplary nickase pairs including selecting a targeting domain from Group A and a second targeting domain from Group B in Table 1D (for S. pyogenes), or selecting a targeting domain from Group A and a second targeting domain from Group B in Table 6D (for S. aureus). It is contemplated herein that in an embodiment a targeting domain of Group A can be combined with any of the targeting domains of Group B in Table 1D (for S. pyogenes). For example, CEP290-B5 or CEP290-B10 can be combined with CEP290-B1 or CEP290-B6. It is contemplated herein that in an embodiment a targeting domain of Group A can be combined with any of the targeting domains of Group B in Table 6D (for S. aureus). For example, CEP290-12 or CEP290-17 can be combined with CEP290-11 or CEP290-16.

In an embodiment, dual targeting (e.g., dual double strand cleavage) is used to create two double strand breaks by using S. pyogenes, S. aureus and N. meningitidis Cas9 nucleases with two targeting domains. It is contemplated herein that in an embodiment any upstream gRNA of any of Tables 1A-1C, 2A-2C, 3A-3D, 4A-4D, 5A-5B, 6A-6C, 7A-7D, 8A-8E, or 9A-9B can be paired with any downstream gRNA of any of Tables 1A-1C, 2A-2C, 3A-3D, 4A-4D, 5A-5B, 6A-6C, 7A-7D, 8A-8E, or 9A-9B. Exemplary nucleases pairs are shown in Table 10, e.g., CEP290-323 can be combined with CEP290-11, CEP290-323 can be combined with CEP290-64, CEP290-490 can be combined with CEP290-496, CEP290-490 can be combined with CEP290-502, CEP290-490 can be combined with CEP290-504, CEP290-492 can be combined with CEP290-502, or CEP290-492 can be combined with CEP290-504.

It is contemplated herein that any upstream gRNA described herein may be paired with any downstream gRNA described herein. When an upstream gRNA designed for use with one species of Cas9 is paired with a downstream gRNA designed for use from a different species of Cas9, both Cas9 species are used to generate a single or double-strand break, as desired.

Exemplary Targeting Domains

Table 1A provides targeting domains for NHEJ-mediated introduction of an indel in close proximity to or including the LCA10 target position in the CEP290 gene selected according to the first tier parameters. The targeting domains are within 40 bases of the LCA10 target position, have good orthogonality, and start with G. It is contemplated herein that the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase).

TABLE 1A

| gRNA Name | DNA Strand | Targeting Domain (SEQ ID NO) | Target Site Length | Position relative to mutation |
|---|---|---|---|---|
| CEP290-B4 | + | GAGAUACUCACAAUUACAAC (395) | 20 | upstream |
| CEP290-B28 | + | GAUACUCACAAUUACAACUG (396) | 20 | upstream |

Table 1B provides targeting domains for NHEJ-mediated introduction of an indel in close proximity to or including the LCA10 target position in the CEP290 gene selected according to the second tier parameters. The targeting domains are within 40 bases of the LCA10 target position, have good orthogonality, and do not start with G. It is contemplated herein that the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase).

TABLE 1B

| gRNA Name | DNA Strand | Targeting Domain (SEQ ID NO) | Target Site Length | Position relative to mutation |
|---|---|---|---|---|
| CEP290-B6 | − | CUCAUACCUAUCCCUAU (594) | 17 | downstream |
| CEP290-B20 | + | ACACUGCCAAUAGGGAU (595) | 17 | downstream |
| CEP290-B10 | + | CAAUUACAACUGGGGCC (596) | 17 | upstream |

TABLE 1B-continued

| gRNA Name | DNA Strand | Targeting Domain (SEQ ID NO) | Target Site Length | Position relative to mutation |
|---|---|---|---|---|
| CEP290-B21 | + | CUAAGACACUGCCAAUA (597) | 17 | downstream |
| CEP290-B9 | + | AUACUCACAAUUACAAC (598) | 17 | upstream |
| CEP290-B1 | - | UAUCUCAUACCUAUCCCUAU (599) | 20 | downstream |
| CEP290-B29 | + | AAGACACUGCCAAUAGGGAU (600) | 20 | downstream |
| CEP290-B5 | + | UCACAAUUACAACUGGGGCC (601) | 20 | upstream |
| CEP290-B30 | + | AGAUACUCACAAUUACAACU (602) | 20 | upstream |

Table 1C provides targeting domains for NHEJ-mediated introduction of an indel in close proximity to or including the LCA10 target position in the CEP290 gene selected according to the fourth tier parameters. The targeting domains are within 40 bases of the LCA10 target position and do not start with G. It is contemplated herein that the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase).

TABLE 1C

| gRNA Name | DNA Strand | Targeting Domain (SEQ ID NO) | Target Site Length | Position relative to mutation |
|---|---|---|---|---|
| CEP290-B22 | + | ACUAAGACACUGCCAAU (603) | 17 | downstream |
| CEP290-B23 | + | UACUCACAAUUACAACU (604) | 17 | upstream |
| CEP290-B24 | + | ACUCACAAUUACAACUG (605) | 17 | upstream |
| CEP290-B25 | + | ACAACUGGGGCCAGGUG (606) | 17 | upstream |
| CEP290-B26 | + | ACUGGGGCCAGGUGCGG (607) | 17 | upstream |
| CEP290-B27 | - | AUGUGAGCCACCGCACC (608) | 17 | upstream |
| CEP290-B31 | + | AAACUAAGACACUGCCAAUA (609) | 20 | downstream |
| CEP290-B32 | + | AAAACUAAGACACUGCCAAU (610) | 20 | upstream |
| CEP290-B33 | + | AUUACAACUGGGGCCAGGUG (611) | 20 | upstream |
| CEP290-B34 | + | ACAACUGGGGCCAGGUGCGG (612) | 20 | upstream |

Table 1D provides targeting domains for NHEJ-mediated introduction of an indel in close proximity to or including the LCA10 target position in the CEP290 gene that can be used for dual targeting. Any of the targeting domains in the table can be used with a S. pyogenes Cas9 (nickase) molecule to generate a single stranded break.

Exemplary nickase pairs including selecting a targeting domain from Group A and a second targeting domain from Group B. It is contemplated herein that a targeting domain of Group A can be combined with any of the targeting domains of Group B. For example, the CEP290-B5 or CEP290-B10 can be combined with CEP290-B1 or CEP290-B6.

TABLE 1D

| Group A | Group B |
|---|---|
| CEP290-B5 | CEP290-B1 |
| CEP290-B10 | CEP290-B6 |

Table 2A provides targeting domains for NHEJ-mediated introduction of an indel in close proximity to or including the LCA10 target position in the CEP290 gene selected according to the first tier parameters. The targeting domains are within 40 bases of the LCA10 target position, have good orthogonality, and start with G. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 2A

| gRNA Name | DNA Strand | Targeting Domain (SEQ ID NO) | Target Site Length | Position relative to mutation |
|---|---|---|---|---|
| CEP290-B1000 | + | GAGAUACUCACAAUUACAAC (395) | 20 | upstream |
| CEP290-B1001 | + | GAUACUCACAAUUACAA (397) | 17 | upstream |

Table 2B provides targeting domains for NHEJ-mediated introduction of an indel in close proximity to or including the LCA10 target position in the CEP290 gene selected according to the second tier parameters. The targeting domains are within 40 bases of the LCA10 target position, have good orthogonality, and do not start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

Table 3A provides targeting domains for break-induced deletion of genomic sequence including the mutation at the LCA10 target position in the CEP290 gene selected according to the first tier parameters. The targeting domains are within 400 bp upstream of an Alu repeat or 700 bp downstream of the mutation, have good orthogonality, and start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 2B

| gRNA Name | DNA Strand | Targeting Domain (SEQ ID NO) | Target Site Length | Position relative to mutation |
|---|---|---|---|---|
| CEP290-B1002 | + | CACUGCCAAUAGGGAUAGGU (613) | 20 | downstream |
| CEP290-B1003 | + | UGCCAAUAGGGAUAGGU (614) | 17 | downstream |
| CEP290-B1004 | + | UGAGAUACUCACAAUUACAA (615) | 20 | upstream |
| CEP290-B1005 | + | AUACUCACAAUUACAAC (598) | 17 | upstream |

Table 2C provides targeting domains for NHEJ-mediated introduction of an indel in close proximity to or including the LCA10 target position in the CEP290 gene selected according to the fourth tier parameters. The targeting domains are within 40 bases of the LCA10 target position, and do not start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 2C

| gRNA Name | DNA Strand | Targeting Domain (SEQ ID NO) | Target Site Length | Position relative to mutation |
|---|---|---|---|---|
| CEP290-B1006 | − | ACCUGGCCCCAGUUGUAAUU (616) | 20 | upstream |
| CEP290-B1007 | − | UGGCCCCAGUUGUAAUU (617) | 17 | upstream |

TABLE 3A

| gRNA Name | DNA Strand | Targeting Domain (SEQ ID NO) | Target Site Length | Position relative to mutation |
|---|---|---|---|---|
| CEP290-B8 | − | GCUACCGGUUACCUGAA (457) | 17 | downstream |
| CEP290-B217 | + | GCAGAACUAGUGUAGAC (458) | 17 | downstream |
| CEP290-B69 | − | GUUGAGUAUCUCCUGUU (459) | 17 | downstream |
| CEP290-B115 | + | GAUGCAGAACUAGUGUAGAC (460) | 20 | downstream |
| CEP290-B187 | + | GCUUGAACUCUGUGCCAAAC (461) | 20 | downstream |

Table 3B provides targeting domains for break-induced deletion of genomic sequence including the mutation at the LCA10 target position in the CEP290 gene selected according to the second tier parameters. The targeting domains are within 400 bp upstream of an Alu repeat or 700 bp downstream of the mutation, have good orthogonality, and do not start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 3B

| gRNA Name | DNA Strand | Targeting Domain (SEQ ID NO) | Target Site Length | Position relative to mutation |
|---|---|---|---|---|
| cep290-B269 | − | AGCUACCGGUUACCUGA (618) | 17 | downstream |
| cep290-B285 | + | UUUAAGGCGGGGAGUCACAU (619) | 20 | downstream |
| CEP290-B3 | − | AAAGCUACCGGUUACCUGAA (620) | 20 | downstream |
| cep290-B207 | − | AAAAGCUACCGGUUACCUGA (621) | 20 | downstream |
| cep290-B106 | − | CUCAUACCUAUCCCUAU (594) | 17 | downstream |
| cep290-B55 | + | ACACUGCCAAUAGGGAU (595) | 17 | downstream |
| cep290-B138 | − | UAUCUCAUACCUAUCCCUAU (599) | 20 | downstream |
| cep290-B62 | − | ACGUGCUCUUUUCUAUAUAU (622) | 20 | downstream |
| cep290-B121 | + | AUUUGACACCACAUGCACUG (623) | 20 | downstream |
| cep290-B120 | − | CGUGCUCUUUUCUAUAUAUA (624) | 20 | downstream |
| cep290-B36 | − | UGGUGUCAAAUAUGGUGCUU (625) | 20 | downstream |
| cep290-B236 | + | ACUUUUACCCUUCAGGUAAC (626) | 20 | downstream |
| cep290-B70 | − | AGUGCAUGUGGUGUCAAAUA (627) | 20 | downstream |
| cep290-B177 | − | UACAUGAGAGUGAUUAGUGG (628) | 20 | downstream |
| cep290-B451 | − | CGUUGUUCUGAGUAGCUUUC (629) | 20 | upstream |
| cep290-B452 | + | CCACAAGAUGUCUCUUGCCU (630) | 20 | upstream |
| cep290-B453 | − | CCUAGGCAAGAGACAUCUUG (631) | 20 | upstream |
| cep290-B454 | + | UGCCUAGGACUUUCUAAUGC (632) | 20 | upstream |
| cep290-B498 | − | CGUUGUUCUGAGUAGCUUUC (629) | 20 | upstream |
| cep290-B523 | − | AUUAGCUCAAAAGCUUUUGC (633) | 20 | upstream |

Table 3C provides targeting domains for break-induced deletion of genomic sequence including the mutation at the LCA10 target position in the CEP290 gene selected according to the third tier parameters. The targeting domains are within 400 bp upstream of an Alu repeat or 700 bp downstream of the mutation, and start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 3C

| gRNA Name | DNA Strand | Targeting Domain (SEQ ID NO) | Target Site Length | |
|---|---|---|---|---|
| CEP290-B87 | - | GCAUGUGGUGUCAAAUA (479) | 17 | downstream |
| CEP290-B50 | + | GAUGACAUGAGGUAAGU (478) | 17 | downstream |
| CEP290-B260 | + | GUCACAUGGGAGUCACA (500) | 17 | downstream |
| CEP290-B283 | - | GAGAGCCACAGUGCAUG (472) | 17 | downstream |
| CEP290-B85 | - | GCUCUUUUCUAUAUAUA (481) | 17 | downstream |
| CEP290-B78 | + | GCUUUUGACAGUUUUUA (634) | 17 | downstream |
| CEP290-B292 | + | GAUAGAGACAGGAAUAA (476) | 17 | downstream |
| CEP290-B278 | + | GGACUUGACUUUUACCCUUC (485) | 20 | downstream |
| CEP290-B227 | + | GGGAGUCACAUGGGAGUCAC (491) | 20 | downstream |
| CEP290-B261 | - | GUGGAGAGCCACAGUGCAUG (501) | 20 | downstream |
| CEP290-B182 | + | GCCUGAACAAGUUUUGAAAC (480) | 20 | downstream |
| CEP290-B67 | + | GGAGUCACAUGGGAGUCACA (487) | 20 | downstream |
| CEP290-B216 | + | GUAAGACUGGAGAUAGAGAC (497) | 20 | downstream |
| CEP290-B241 | + | GCUUUUGACAGUUUUUAAGG -482 | 20 | downstream |
| CEP290-B161 | + | GUUUAGAAUGAUCAUUCUUG -504 | 20 | downstream |
| CEP290-B259 | + | GUAGCUUUUGACAGUUUUUA -499 | 20 | downstream |
| CEP290-B79 | + | GGAGAUAGAGACAGGAAUAA (635) | 20 | downstream |
| CEP290-B436 | + | GUUCUGUCCUCAGUAAA (503) | 17 | upstream |
| CEP290-B444 | + | GGAUAGGACAGAGGACA (488) | 17 | upstream |
| CEP290-B445 | + | GAUGAAAAAUACUCUUU (477) | 17 | upstream |
| CEP290-B459 | - | GAACUCUAUACCUUUUACUG (466) | 20 | upstream |
| CEP290-B465 | + | GUAACAUAAUCACCUCUCUU (496) | 20 | upstream |
| CEP290-B473 | + | GAAAGAUGAAAAAUACUCUU (462) | 20 | upstream |
| CEP290-B528 | + | GUAACAUAAUCACCUCUCUU (496) | 20 | upstream |

Table 3D provides targeting domains for break-induced deletion of genomic sequence including the mutation at the LCA10 target position in the CEP290 gene selected according to the fourth tier parameters. The targeting domains are within 400 bp upstream of an Alu repeat or 700 bp downstream of the mutation, and do not start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 3D

| gRNA Name | DNA Strand | Targeting Domain (SEQ ID NO) | Target Site Length | |
|---|---|---|---|---|
| CEP290-B233 | + | AAGGCGGGGAGUCACAU (636) | 17 | downstream |
| CEP290-B175 | + | UAAGGCGGGGAGUCACA (637) | 17 | downstream |
| CEP290-B280 | + | UGAACUCUGUGCCAAAC (638) | 17 | downstream |
| CEP290-B92 | + | CUAAGACACUGCCAAUA (597) | 17 | downstream |
| CEP290-B268 | + | UUUACCCUUCAGGUAAC (639) | 17 | downstream |
| CEP290-B154 | + | UGCACCACAUGCACUG (640) | 17 | downstream |
| CEP290-B44 | + | ACUAAGACACUGCCAAU (603) | 17 | downstream |
| CEP290-B231 | + | UUGCUCUAGAUGACAUG (641) | 17 | downstream |
| CEP290-B242 | + | UGACAGUUUUUAAGGCG (642) | 17 | downstream |
| CEP290-B226 | − | UGUCAAAUAUGGUGCUU (643) | 17 | downstream |
| CEP290-B159 | + | AGUCACAUGGGAGUCAC (644) | 17 | downstream |
| CEP290-B222 | − | AUGAGAGUGAUUAGUGG (645) | 17 | downstream |
| CEP290-B274 | + | UGACAUGAGGUAAGUAG (646) | 17 | downstream |
| CEP290-B68 | − | UACAUGAGAGUGAUUAG (647) | 17 | downstream |
| CEP290-B212 | + | UAAGGAGGAUGUAAGAC (648) | 17 | downstream |
| CEP290-B270 | + | CUUGACUUUUACCCUUC (649) | 17 | downstream |
| CEP290-B96 | + | UCACUGAGCAAAACAAC (650) | 17 | downstream |
| CEP290-B104 | + | AGACUUAUAUUCCAUUA (651) | 17 | downstream |
| CEP290-B122 | + | CAUGGGAGUCACAGGGU (652) | 17 | downstream |
| CEP290-B229 | + | UAGAAUGAUCAUUCUUG (653) | 17 | downstream |
| CEP290-B99 | + | UUGACAGUUUUUAAGGC (654) | 17 | downstream |
| CEP290-B7 | − | AAACUGUCAAAAGCUAC (655) | 17 | downstream |
| CEP290-B41 | + | UCAUUCUUGUGGCAGUA (2780) | 17 | downstream |
| CEP290-B37 | + | AUGACAUGAGGUAAGUA (656) | 17 | downstream |
| CEP290-B97 | − | UGUUUCAAAACUUGUUC (657) | 17 | downstream |
| CEP290-B173 | − | AUAUCUGUCUUCCUUAA (658) | 17 | downstream |
| CEP290-B136 | + | UGAACAAGUUUUGAAAC (659) | 17 | downstream |
| CEP290-B71 | − | UUCUGCAUCUUAUACAU (660) | 17 | downstream |
| CEP290-B172 | − | AUAAGUCUUUUGAUAUA (661) | 17 | downstream |
| CEP290-B238 | + | UUUGACAGUUUUUAAGG (662) | 17 | downstream |
| CEP290-B148 | − | UGCUCUUUUCUAUAUAU (663) | 17 | downstream |
| CEP290-B208 | + | AGACUGGAGAUAGAGAC (664) | 17 | downstream |
| CEP290-B53 | + | CAUAAGAAAGAACACUG (665) | 17 | downstream |
| CEP290-B166 | + | UUCUUGUGGCAGUAAGG (666) | 17 | downstream |
| CEP290-B247 | − | AAGCAUACUUUUUUUAA (667) | 17 | downstream |
| CEP290-B245 | + | CAACUGGAAGAGAGAAA (668) | 17 | downstream |
| CEP290-B167 | + | UAUGCUUAAGAAAAAAA (669) | 17 | downstream |
| CEP290-B171 | − | UUUUAUUAUCUUUAUUG (670) | 17 | downstream |

TABLE 3D-continued

| gRNA Name | DNA Strand | Targeting Domain (SEQ ID NO) | Target Site Length | |
|---|---|---|---|---|
| CEP290-B140 | + | CUAGAUGACAUGAGGUAAGU (671) | 20 | downstream |
| CEP290-B147 | + | UUUUAAGGCGGGGAGUCACA (672) | 20 | downstream |
| CEP290-B253 | + | AAGACACUGCCAAUAGGGAU (600) | 20 | downstream |
| CEP290-B73 | − | UCCUGUUUCAAAACUUGUUC (673) | 20 | downstream |
| CEP290-B206 | − | UGUGUUGAGUAUCUCCUGUU (674) | 20 | downstream |
| CEP290-B57 | + | CUCUUGCUCUAGAUGACAUG (675) | 20 | downstream |
| CEP290-B82 | + | CAGUAAGGAGGAUGUAAGAC (676) | 20 | downstream |
| CEP290-B265 | + | AGAUGACAUGAGGUAAGUAG (677) | 20 | downstream |
| CEP290-B105 | + | AAUUCACUGAGCAAAACAAC (678) | 20 | downstream |
| CEP290-B239 | + | UCACAUGGGAGUCACAGGGU (679) | 20 | downstream |
| CEP290-B180 | + | UAGAUGACAUGAGGUAAGUA (680) | 20 | downstream |
| CEP290-B103 | + | UUUUGACAGUUUUUAAGGCG (681) | 20 | downstream |
| CEP290-B254 | − | UAAUACAUGAGAGUGAUUAG (682) | 20 | downstream |
| CEP290-B134 | − | UAGUUCUGCAUCUUUAUACAU (683) | 20 | downstream |
| CEP290-B151 | + | AAACUAAGACACUGCCAAUA (609) | 20 | downstream |
| CEP290-B196 | + | AAAACUAAGACACUGCCAAU (610) | 20 | downstream |
| CEP290-B2 | − | UAAAAACUGUCAAAAGCUAC (506) | 20 | downstream |
| CEP290-B240 | + | CUUUUGACAGUUUUUAAGGC (684) | 20 | downstream |
| CEP290-B116 | + | AAAAGACUUAUAUUCCAUUA (685) | 20 | downstream |
| CEP290-B39 | + | AUACAUAAGAAAGAACACUG (686) | 20 | downstream |
| CEP290-B91 | − | AAUAUAAGUCUUUUGAUAUA (687) | 20 | downstream |
| CEP290-B126 | + | UGAUCAUUCUUGUGGCAGUA (688) | 20 | downstream |
| CEP290-B202 | − | UACAUAUCUGUCUUCCUUAA (689) | 20 | downstream |
| CEP290-B152 | − | CUUAAGCAUACUUUUUUUAA (690) | 20 | downstream |
| CEP290-B77 | + | AAACAACUGGAAGAGAGAAA (691) | 20 | downstream |
| CEP290-B145 | + | UCAUUCUUGUGGCAGUAAGG (692) | 20 | downstream |
| CEP290-B72 | + | AAGUAUGCUUAAGAAAAAAA (693) | 20 | downstream |
| CEP290-B221 | − | AUUUUUAUUAUCUUUAUUG (694) | 20 | downstream |
| CEP290-B424 | + | CUAGGACUUUCUAAUGC (695) | 17 | upstream |
| CEP290-B425 | − | AUCUAAGAUCCUUUCAC (696) | 17 | upstream |
| CEP290-B426 | + | UUAUCACCACACUAAAU (697) | 17 | upstream |

TABLE 3D-continued

| gRNA Name | DNA Strand | Targeting Domain (SEQ ID NO) | Target Site Length | |
|---|---|---|---|---|
| CEP290-B427 | − | AGCUCAAAAGCUUUUGC (698) | 17 | upstream |
| CEP290-B428 | − | UGUUCUGAGUAGCUUUC (699) | 17 | upstream |
| CEP290-B429 | + | ACUUUCUAAUGCUGGAG (700) | 17 | upstream |
| CEP290-B430 | − | CUCUAUACCUUUUACUG (701) | 17 | upstream |
| CEP290-B431 | + | CAAGAUGUCUCUUGCCU (702) | 17 | upstream |
| CEP290-B432 | − | AUUAUGCCUAUUUAGUG (703) | 17 | upstream |
| CEP290-B433 | + | AUGACUCAUAAUUUAGU (704) | 17 | upstream |
| CEP290-B434 | − | UAGAGGCUUAUGGAUUU (705) | 17 | upstream |
| CEP290-B435 | + | UAUUCUACUCCUGUGAA (706) | 17 | upstream |
| CEP290-B437 | + | CUAAUGCUGGAGAGGAU (707) | 17 | upstream |
| CEP290-B438 | − | AGGCAAGAGACAUCUUG (708) | 17 | upstream |
| CEP290-B439 | + | AGCCUCUAUUUCUGAUG (709) | 17 | upstream |
| CEP290-B440 | − | CAGCAUUAGAAAGUCCU (710) | 17 | upstream |
| CEP290-B441 | − | CUGCUUUUGCCAAAGAG (711) | 17 | upstream |
| CEP290-B442 | + | ACAUAAUCACCUCUCUU (712) | 17 | upstream |
| CEP290-B443 | − | UCAGAAAUAGAGGCUUA (713) | 17 | upstream |
| CEP290-B446 | − | UUCCUCAUCAGAAAUAG (714) | 17 | upstream |
| CEP290-B447 | + | ACAGAGGACAUGGAGAA (715) | 17 | upstream |
| CEP290-B448 | + | UGGAGAGGAUAGGACAG (716) | 17 | upstream |
| CEP290-B449 | + | AGGAAGAUGAACAAAUC (717) | 17 | upstream |
| CEP290-B450 | + | AGAUGAAAAAUACUCUU (718) | 17 | upstream |
| CEP290-B455 | + | AGGACUUUCUAAUGCUGGAG (719) | 20 | upstream |
| CEP290-B456 | − | AUUAGCUCAAAAGCUUUUGC (633) | 20 | upstream |
| CEP290-B457 | − | CUCCAGCAUUAGAAAGUCCU (720) | 20 | upstream |
| CEP290-B458 | + | AACAUGACUCAUAAUUUAGU (721) | 20 | upstream |
| CEP290-B460 | − | AUCUUCCUCAUCAGAAAUAG (722) | 20 | upstream |
| CEP290-B461 | + | AUAAGCCUCUAUUUCUGAUG (723) | 20 | upstream |
| CEP290-B462 | + | UCUUAUUCUACUCCUGUGAA (724) | 20 | upstream |
| CEP290-B463 | − | CUGCUGCUUUUGCCAAAGAG (725) | 20 | upstream |
| CEP290-B464 | + | UUUCUAAUGCUGGAGAGGAU (726) | 20 | upstream |
| CEP290-B466 | + | AAAUUAUCACCACACUAAAU (727) | 20 | upstream |
| CEP290-B467 | + | CUUGUUCUGUCCUCAGUAAA (728) | 20 | upstream |
| CEP290-B468 | − | AAAAUUAUGCCUAUUUAGUG (729) | 20 | upstream |
| CEP290-B469 | − | UCAUCAGAAAUAGAGGCUUA (730) | 20 | upstream |
| CEP290-B470 | − | AAAUAGAGGCUUAUGGAUUU (731) | 20 | upstream |
| CEP290-B471 | + | UGCUGGAGAGGAUAGGACAG (732) | 20 | upstream |

TABLE 3D-continued

| gRNA Name | DNA Strand | Targeting Domain (SEQ ID NO) | Target Site Length | |
|---|---|---|---|---|
| CEP290-B472 | + | AUGAGGAAGAUGAACAAAUC (733) | 20 | upstream |
| CEP290-B474 | − | CUUAUCUAAGAUCCUUUCAC (734) | 20 | upstream |
| CEP290-B475 | + | AGAGGAUAGGACAGAGGACA (735) | 20 | upstream |
| CEP290-B476 | + | AGGACAGAGGACAUGGAGAA (736) | 20 | upstream |
| CEP290-B477 | + | AAAGAUGAAAAAUACUCUUU (737) | 20 | upstream |
| CEP290-B495 | − | AGCUCAAAAGCUUUUGC (738) | 17 | upstream |
| CEP290-B529 | − | UGUUCUGAGUAGCUUUC (739) | 17 | upstream |
| CEP290-B513 | + | AUGACUCAUAAUUUAGU (740) | 17 | upstream |
| CEP290-B490 | + | UAUUCUACUCCUGUGAA (741) | 17 | upstream |
| CEP290-B485 | − | CUGCUUUUGCCAAAGAG (742) | 17 | upstream |
| CEP290-B492 | + | ACAUAAUCACCUCUCUU (743) | 17 | upstream |
| CEP290-B506 | + | AACAUGACUCAUAAUUUAGU (744) | 20 | upstream |
| CEP290-B500 | + | UCUUAUUCUACUCCUGUGAA (745) | 20 | upstream |
| CEP290-B521 | − | CUGCUGCUUUUGCCAAAGAG (746) | 20 | upstream |

Table 4A provides targeting domains for break-induced deletion of genomic sequence including the mutation at the LCA10 target position in the CEP290 gene selected according to the first tier parameters. The targeting domains are within 400 bp upstream of an Alu repeat or 700 bp downstream of the mutation, have good orthogonality, and start with G. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 4A

| gRNA Name | DNA Strand | Targeting Domain (SEQ ID NO) | Target Site Length | Position relative to mutation |
|---|---|---|---|---|
| CEP290-B1008 | + | GAAUCCUGAAAGCUACU (510) | 17 | upstream |

Table 4B provides targeting domains for break-induced deletion of genomic sequence including the mutation at the LCA10 target position in the CEP290 gene selected according to the second tier parameters. The targeting domains are within 400 bp upstream of an Alu repeat or 700 bp downstream of the mutation, have good orthogonality, and do not start with G. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 4B

| gRNA Name | DNA Strand | Targeting Domain (SEQ ID NO) | Target Site Length | Position relative to mutation |
|---|---|---|---|---|
| CEP290-B1009 | − | CCUACUUACCUCAUGUCAUC (747) | 20 | downstream |
| CEP290-B1010 | + | CUAUGAGCCAGCAAAAGCUU (748) | 20 | upstream |
| CEP290-B1011 | − | ACGUUGUUCUGAGUAGCUUU (749) | 20 | upstream |

TABLE 4B-continued

| gRNA Name | DNA Strand | Targeting Domain (SEQ ID NO) | Target Site Length | Position relative to mutation |
|---|---|---|---|---|
| CEP290-B1012 | - | CAUAGAGACACAUUCAGUAA (750) | 20 | upstream |
| CEP290-B1013 | - | ACUUACCUCAUGUCAUC (751) | 17 | downstream |
| CEP290-B1014 | + | UGAGCCAGCAAAAGCUU (752) | 17 | upstream |
| CEP290-B1015 | - | UUGUUCUGAGUAGCUUU (753) | 17 | upstream |
| CEP290-B1016 | - | AGAGACACAUUCAGUAA (754) | 17 | upstream |
| CEP290-B1017 | + | UUUAAGGCGGGGAGUCACAU (619) | 20 | downstream |
| CEP290-B1018 | - | CAAAAGCUACCGGUUACCUG (755) | 20 | downstream |
| CEP290-B1019 | + | UUUUAAGGCGGGGAGUCACA (756) | 20 | downstream |
| CEP290-B1020 | - | UGUCAAAAGCUACCGGUUAC (757) | 20 | downstream |
| CEP290-B1021 | + | AAGGCGGGGAGUCACAU (636) | 17 | downstream |
| CEP290-B1022 | - | AAGCUACCGGUUACCUG (758) | 17 | downstream |
| CEP290-B1023 | + | UAAGGCGGGGAGUCACA (637) | 17 | downstream |
| CEP290-B1024 | - | CAAAAGCUACCGGUUAC (759) | 17 | downstream |
| CEP290-B1025 | + | UAGGAAUCCUGAAAGCUACU (760) | 20 | upstream |
| CEP290-B1026 | + | CAGAACAACGUUUUCAUUUA (761) | 20 | upstream |
| CEP290-B1027 | - | CAAAAGCUUUUGCUGGCUCA (762) | 20 | upstream |
| CEP290-B1028 | + | AGCAAAAGCUUUUGAGCUAA (763) | 20 | upstream |
| CEP290-B1029 | + | AUCUUAUUCUACUCCUGUGA (764) | 20 | upstream |
| CEP290-B1030 | + | AACAACGUUUUCAUUUA (765) | 17 | upstream |
| CEP290-B1031 | - | AAGCUUUUGCUGGCUCA (766) | 17 | upstream |
| CEP290-B1032 | + | AAAAGCUUUUGAGCUAA (767) | 17 | upstream |
| CEP290-B1033 | + | UUAUUCUACUCCUGUGA (768) | 17 | upstream |

Table 4C provides targeting domains for break-induced deletion of genomic sequence including the mutation at the LCA10 target position in the CEP290 gene selected according to the third tier parameters. The targeting domains are within 400 bp upstream of an Alu repeat or 700 bp downstream of the mutation, and start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 4C

| gRNA Name | DNA Strand | Targeting Domain (SEQ ID NO) | Target Site Length | Position relative to mutation |
|---|---|---|---|---|
| CEP290-B1034 | + | GAAACAGGAAUAGAAAUUCA (769) | 20 | downstream |
| CEP290-B1035 | + | GAAAGAUGAAAAAUACUCUU (462) | 20 | upstream |
| CEP290-B1036 | - | GAAAUAGAGGCUUAUGGAUU (547) | 20 | upstream |
| CEP290-B1037 | - | GAAUAUAAGUCUUUUGAUAU (770) | 20 | downstream |
| CEP290-B1038 | + | GAGAAAUGGUUCCCUAUAUA (771) | 20 | downstream |

TABLE 4C-continued

| gRNA Name | DNA Strand | Targeting Domain (SEQ ID NO) | Target Site Length | Position relative to mutation |
|---|---|---|---|---|
| CEP290-B1039 | + | GAGAGGAUAGGACAGAGGAC (772) | 20 | upstream |
| CEP290-B1040 | + | GAUGAGGAAGAUGAACAAAU (773) | 20 | upstream |
| CEP290-B1041 | + | GAUGCAGAACUAGUGUAGAC (460) | 20 | downstream |
| CEP290-B1042 | − | GAUUUGUUCAUCUUCCUCAU (774) | 20 | upstream |
| CEP290-B1043 | + | GCAGUAAGGAGGAUGUAAGA (775) | 20 | downstream |
| CEP290-B1044 | + | GCCUGAACAAGUUUUGAAAC (480) | 20 | downstream |
| CEP290-B1045 | + | GCUUGAACUCUGUGCCAAAC (461) | 20 | downstream |
| CEP290-B1046 | − | GCUUUCUGCUGCUUUUGCCA (776) | 20 | upstream |
| CEP290-B1047 | − | GCUUUCUGCUGCUUUUGCCA (777) | 20 | upstream |
| CEP290-B1048 | + | GCUUUUGACAGUUUUUAAGG (482) | 20 | downstream |
| CEP290-B1049 | + | GGAAAGAUGAAAAAUACUCU (778) | 20 | upstream |
| CEP290-B1050 | + | GGAGGAUGUAAGACUGGAGA (779) | 20 | downstream |
| CEP290-B1051 | + | GGGGAGUCACAUGGGAGUCA (573) | 20 | downstream |
| CEP290-B1052 | − | GGUGAUUAUGUUACUUUUUA (780) | 20 | upstream |
| CEP290-B1053 | − | GGUGAUUAUGUUACUUUUUA (781) | 20 | upstream |
| CEP290-B1054 | + | GUAAGACUGGAGAUAGAGAC (497) | 20 | downstream |
| CEP290-B1055 | + | GUCACAUGGGAGUCACAGGG (586) | 20 | downstream |
| CEP290-B1056 | − | GUGGUGUCAAAUAUGGUGCU (782) | 20 | downstream |
| CEP290-B1057 | + | GAAAAAAAAGGUAAUGC (783) | 17 | downstream |
| CEP290-B1058 | + | GAAAAGAGCACGUACAA (784) | 17 | downstream |
| CEP290-B1059 | + | GAAUCCUGAAAGCUACU (510) | 17 | upstream |
| CEP290-B1060 | − | GAAUGAUCAUUCUAAAC (785) | 17 | downstream |
| CEP290-B1061 | + | GACAGAGGACAUGGAGA (786) | 17 | upstream |
| CEP290-B1062 | + | GACUUUCUAAUGCUGGA (787) | 17 | upstream |
| CEP290-B1063 | − | GAGAGUGAUUAGUGGUG (788) | 17 | downstream |
| CEP290-B1064 | + | GAGCAAAACAACUGGAA (789) | 17 | downstream |
| CEP290-B1065 | + | GAGGAAGAUGAACAAAU (790) | 17 | upstream |
| CEP290-B1066 | + | GAGUCACAUGGGAGUCA (791) | 17 | downstream |
| CEP290-B1067 | + | GAUCUUAUUCUACUCCU (792) | 17 | upstream |
| CEP290-B1068 | + | GAUCUUAUUCUACUCCU (792) | 17 | upstream |
| CEP290-B1069 | + | GAUGAAAAAUACUCUUU (477) | 17 | upstream |
| CEP290-B1070 | + | GAUGACAUGAGGUAAGU (478) | 17 | downstream |
| CEP290-B1071 | − | GAUUAUGUUACUUUUUA (793) | 17 | upstream |

TABLE 4C-continued

| gRNA Name | DNA Strand | Targeting Domain (SEQ ID NO) | Target Site Length | Position relative to mutation |
|---|---|---|---|---|
| CEP290-B1072 | − | GAUUAUGUUACUUUUUA (793) | 17 | upstream |
| CEP290-B1073 | + | GCAAAACAACUGGAAGA (794) | 17 | downstream |
| CEP290-B1074 | + | GCAGAACUAGUGUAGAC (458) | 17 | downstream |
| CEP290-B1075 | − | GCUCUUUUCUAUAUAUA (481) | 17 | downstream |
| CEP290-B1076 | + | GGAUAGGACAGAGGACA (488) | 17 | upstream |
| CEP290-B1077 | + | GGAUGUAAGACUGGAGA (795) | 17 | downstream |
| CEP290-B1078 | + | GUAAGGAGGAUGUAAGA (796) | 17 | downstream |
| CEP290-B1079 | − | GUAUCUCCUGUUUGGCA (797) | 17 | downstream |
| CEP290-B1080 | − | GUCAUCUAGAGCAAGAG (798) | 17 | downstream |
| CEP290-B1081 | + | GUCCUCAGUAAAAGGUA (799) | 17 | upstream |
| CEP290-B1082 | + | GUGAAAGGAUCUUAGAU (800) | 17 | upstream |
| CEP290-B1083 | − | GUGCUCUUUUCUAUAUA (801) | 17 | downstream |
| CEP290-B1084 | − | GUGUCAAAUAUGGUGCU (802) | 17 | downstream |
| CEP290-B1085 | + | GUUCCCUAUAUAUAGAA (803) | 17 | downstream |

Table 4D provides targeting domains for break-induced deletion of genomic sequence including the mutation at the LCA10 target position in the CEP290 gene selected according to the fourth tier parameters. The targeting domains are within 400 bp upstream of an Alu repeat or 700 bp downstream of the mutation, and do not start with G. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 4D

| gRNA Name | DNA Strand | Targeting Domain (SEQ ID NO) | Target Site Length | Position relative to mutation |
|---|---|---|---|---|
| CEP290-B1086 | + | AAAACUAAGACACUGCCAAU (610) | 20 | downstream |
| CEP290-B1087 | + | AAAAGACUUAUAUUCCAUUA (804) | 20 | downstream |
| CEP290-B1088 | + | AAACAUGACUCAUAAUUUAG (805) | 20 | upstream |
| CEP290-B1089 | + | AAACAUGACUCAUAAUUUAG (806) | 20 | upstream |
| CEP290-B1090 | + | AAAGAUGAAAAAUACUCUUU (807) | 20 | upstream |
| CEP290-B1091 | + | AAAUUCACUGAGCAAAACAA (808) | 20 | downstream |
| CEP290-B1092 | + | AACAAGUUUUGAAACAGGAA (809) | 20 | downstream |
| CEP290-B1093 | + | AACAGGAGAUACUCAACACA (810) | 20 | downstream |
| CEP290-B1094 | + | AACAUGACUCAUAAUUUAGU (811) | 20 | upstream |
| CEP290-B1095 | + | AACAUGACUCAUAAUUUAGU (812) | 20 | upstream |
| CEP290-B1096 | − | AAUAUAAGUCUUUUGAUAUA (813) | 20 | downstream |
| CEP290-B1097 | + | AAUCACUCUCAUGUAUUAGC (814) | 20 | downstream |
| CEP290-B1098 | + | AAUUCACUGAGCAAAACAAC (815) | 20 | downstream |
| CEP290-B1099 | + | ACAAAAGAACAUACAUAAGA (816) | 20 | downstream |
| CEP290-B1100 | + | ACGUACAAAAGAACAUACAU (817) | 20 | downstream |

TABLE 4D-continued

| gRNA Name | DNA Strand | Targeting Domain (SEQ ID NO) | Target Site Length | Position relative to mutation |
|---|---|---|---|---|
| CEP290-B1101 | − | ACGUGCUCUUUUCUAUAUAU (622) | 20 | downstream |
| CEP290-B1102 | − | ACGUUGUUCUGAGUAGCUUU (818) | 20 | upstream |
| CEP290-B1103 | + | ACUGAGCAAAACAACUGGAA (819) | 20 | downstream |
| CEP290-B1104 | + | AGAGGAUAGGACAGAGGACA (820) | 20 | upstream |
| CEP290-B1105 | + | AGAUGCAGAACUAGUGUAGA (821) | 20 | downstream |
| CEP290-B1106 | + | AGCAAAAGCUUUUGAGCUAA (822) | 20 | upstream |
| CEP290-B1107 | − | AGCAUUAGAAAGUCCUAGGC (823) | 20 | upstream |
| CEP290-B1108 | + | AGCUUGAACUCUGUGCCAAA (824) | 20 | downstream |
| CEP290-B1109 | + | AGCUUUUGACAGUUUUUAAG (825) | 20 | downstream |
| CEP290-B1110 | + | AGGACAGAGGACAUGGAGAA (826) | 20 | upstream |
| CEP290-B1111 | + | AGGAUAGGACAGAGGACAUG (827) | 20 | upstream |
| CEP290-B1112 | + | AGGUAAUGCCUGAACAAGUU (828) | 20 | downstream |
| CEP290-B1113 | + | AUAAGAAAGAACACUGUGGU (829) | 20 | downstream |
| CEP290-B1114 | + | AUAAGCCUCUAUUUCUGAUG (830) | 20 | upstream |
| CEP290-B1115 | − | AUACAUGAGAGUGAUUAGUG (831) | 20 | downstream |
| CEP290-B1116 | + | AUAGAAAAGAGCACGUACAA (832) | 20 | downstream |
| CEP290-B1117 | + | AUCAUUCUUGUGGCAGUAAG (833) | 20 | downstream |
| CEP290-B1118 | + | AUCUUAUUCUACUCCUGUGA (834) | 20 | upstream |
| CEP290-B1119 | − | AUCUUGUGGAUAAUGUAUCA (835) | 20 | upstream |
| CEP290-B1120 | + | AUGAGGAAGAUGAACAAAUC (836) | 20 | upstream |
| CEP290-B1121 | + | AUGAUCAUUCUUGUGGCAGU (837) | 20 | downstream |
| CEP290-B1122 | + | AUGCUGGAGAGGAUAGGACA (838) | 20 | upstream |
| CEP290-B1123 | + | AUGGUUCCCUAUAUAUAGAA (839) | 20 | downstream |
| CEP290-B1124 | − | AUUUAAUUUGUUUCUGUGUG (840) | 20 | downstream |
| CEP290-B1125 | + | CAAAACCUAUGUAUAAGAUG (841) | 20 | downstream |
| CEP290-B1126 | + | CAAAAGACUUAUAUUCCAUU (842) | 20 | downstream |
| CEP290-B1127 | − | CAAAAGCUUUUGCUGGCUCA (843) | 20 | upstream |
| CEP290-B1128 | − | CAAGAAUGAUCAUUCUAAAC (844) | 20 | downstream |
| CEP290-B1129 | − | CACAGAGUUCAAGCUAAUAC (845) | 20 | downstream |
| CEP290-B1130 | + | CACAGGGUAGGAUUCAUGUU (846) | 20 | downstream |
| CEP290-B1131 | + | CACUGCCAAUAGGGAUAGGU (613) | 20 | downstream |
| CEP290-B1132 | + | CAGAACAACGUUUUCAUUUA (847) | 20 | upstream |
| CEP290-B1133 | − | CAGAGUUCAAGCUAAUACAU (848) | 20 | downstream |

TABLE 4D-continued

| gRNA Name | DNA Strand | Targeting Domain (SEQ ID NO) | Target Site Length | Position relative to mutation |
|---|---|---|---|---|
| CEP290-B1134 | − | CAGUAAAUGAAAACGUUGUU (849) | 20 | upstream |
| CEP290-B1135 | − | CAGUAAAUGAAAACGUUGUU (849) | 20 | upstream |
| CEP290-B1136 | + | CAGUAAGGAGGAUGUAAGAC (850) | 20 | downstream |
| CEP290-B1137 | + | CAUAAGCCUCUAUUUCUGAU (851) | 20 | upstream |
| CEP290-B1138 | − | CAUAGAGACACAUUCAGUAA (852) | 20 | upstream |
| CEP290-B1139 | + | CAUCUCUUGCUCUAGAUGAC (853) | 20 | downstream |
| CEP290-B1140 | − | CAUGAGAGUGAUUAGUGGUG (854) | 20 | downstream |
| CEP290-B1141 | − | CAUGUCAUCUAGAGCAAGAG (855) | 20 | downstream |
| CEP290-B1142 | + | CAUUUACUGAAUGUGUCUCU (856) | 20 | upstream |
| CEP290-B1143 | + | CAUUUACUGAAUGUGUCUCU (856) | 20 | upstream |
| CEP290-B1144 | + | CCAUUAAAAAAAGUAUGCUU (857) | 20 | downstream |
| CEP290-B1145 | + | CCUAGGACUUUCUAAUGCUG (858) | 20 | upstream |
| CEP290-B1146 | + | CCUCUCUUUGGCAAAAGCAG (859) | 20 | upstream |
| CEP290-B1147 | + | CCUCUCUUUGGCAAAAGCAG (859) | 20 | upstream |
| CEP290-B1148 | + | CCUGUGAAAGGAUCUUAGAU (860) | 20 | upstream |
| CEP290-B1149 | − | CGUGCUCUUUUCUAUAUAUA (624) | 20 | downstream |
| CEP290-B1150 | − | CUAAGAUCCUUUCACAGGAG (861) | 20 | upstream |
| CEP290-B1151 | + | CUAGAUGACAUGAGGUAAGU (862) | 20 | downstream |
| CEP290-B1152 | + | CUAUGAGCCAGCAAAAGCUU (863) | 20 | upstream |
| CEP290-B1153 | + | CUCAUAAUUUAGUAGGAAUC (864) | 20 | upstream |
| CEP290-B1154 | + | CUCAUAAUUUAGUAGGAAUC (864) | 20 | upstream |
| CEP290-B1155 | − | CUCAUCAGAAAUAGAGGCUU (865) | 20 | upstream |
| CEP290-B1156 | + | CUCUAUUUCUGAUGAGGAAG (866) | 20 | upstream |
| CEP290-B1157 | − | CUUAAGCAUACUUUUUUUAA (867) | 20 | downstream |
| CEP290-B1158 | − | CUUAUCUAAGAUCCUUUCAC (868) | 20 | upstream |
| CEP290-B1159 | + | CUUUCUAAUGCUGGAGAGGA (869) | 20 | upstream |
| CEP290-B1160 | + | CUUUUGACAGUUUUUAAGGC (870) | 20 | downstream |
| CEP290-B1161 | + | UAAAACUAAGACACUGCCAA (871) | 20 | downstream |
| CEP290-B1162 | + | UAAGAAAAAAAGGUAAUGC (872) | 20 | downstream |
| CEP290-B1163 | + | UAAUGCUGGAGAGGAUAGGA (873) | 20 | upstream |
| CEP290-B1164 | − | UACAUAUCUGUCUUCCUUAA (874) | 20 | downstream |

TABLE 4D-continued

| gRNA Name | DNA Strand | Targeting Domain (SEQ ID NO) | Target Site Length | Position relative to mutation |
|---|---|---|---|---|
| CEP290-B1165 | − | UACAUCCUCCUUACUGCCAC (875) | 20 | downstream |
| CEP290-B1166 | − | UACAUGAGAGUGAUUAGUGG (628) | 20 | downstream |
| CEP290-B1167 | − | UACCUCAUGUCAUCUAGAGC (876) | 20 | downstream |
| CEP290-B1168 | − | UACGUGCUCUUUUCUAUAUA (877) | 20 | downstream |
| CEP290-B1169 | − | UAGAGCAAGAGAUGAACUAG (878) | 20 | downstream |
| CEP290-B1170 | + | UAGAUGACAUGAGGUAAGUA (879) | 20 | downstream |
| CEP290-B1171 | + | UAGGAAUCCUGAAAGCUACU (880) | 20 | upstream |
| CEP290-B1172 | + | UAGGACAGAGGACAUGGAGA (881) | 20 | upstream |
| CEP290-B1173 | + | UAGGACUUUCUAAUGCUGGA (882) | 20 | upstream |
| CEP290-B1174 | + | UCACUGAGCAAAACAACUGG (883) | 20 | downstream |
| CEP290-B1175 | − | UCAUGUUUAUCAAUAUUAUU (884) | 20 | upstream |
| CEP290-B1176 | − | UCAUGUUUAUCAAUAUUAUU (884) | 20 | upstream |
| CEP290-B1177 | + | UCCACAAGAUGUCUCUUGCC (885) | 20 | upstream |
| CEP290-B1178 | + | UCCAUAAGCCUCUAUUUCUG (886) | 20 | upstream |
| CEP290-B1179 | − | UCCUAGGCAAGAGACAUCUU (887) | 20 | upstream |
| CEP290-B1180 | + | UCUAGAUGACAUGAGGUAAG (888) | 20 | downstream |
| CEP290-B1181 | − | UCUAUACCUUUUACUGAGGA (889) | 20 | upstream |
| CEP290-B1182 | + | UCUGUCCUCAGUAAAAGGUA (890) | 20 | upstream |
| CEP290-B1183 | − | UCUUAAGCAUACUUUUUUUA (891) | 20 | downstream |
| CEP290-B1184 | − | UCUUAUCUAAGAUCCUUUCA (892) | 20 | upstream |
| CEP290-B1185 | − | UCUUCCAGUUGUUUUGCUCA (893) | 20 | downstream |
| CEP290-B1186 | + | UGAGCAAAACAACUGGAAGA (894) | 20 | downstream |
| CEP290-B1187 | − | UGAGUAUCUCCUGUUUGGCA (895) | 20 | downstream |
| CEP290-B1188 | + | UGAUCAUUCUUGUGGCAGUA (896) | 20 | downstream |
| CEP290-B1189 | + | UGCCUAGGACUUUCUAAUGC (632) | 20 | upstream |
| CEP290-B1190 | + | UGCCUGAACAAGUUUUGAAA (897) | 20 | downstream |
| CEP290-B1191 | − | UGGUGUCAAAUAUGGUGCUU (625) | 20 | downstream |
| CEP290-B1192 | + | UGUAAGACUGGAGAUAGAGA (898) | 20 | downstream |
| CEP290-B1193 | − | UGUCCUAUCCUCUCCAGCAU (899) | 20 | upstream |
| CEP290-B1194 | − | UUAACGUUAUCAUUUUCCCA (900) | 20 | upstream |
| CEP290-B1195 | − | UUACAUAUCUGUCUUCCUUA (901) | 20 | downstream |

TABLE 4D-continued

| gRNA Name | DNA Strand | Targeting Domain (SEQ ID NO) | Target Site Length | Position relative to mutation |
|---|---|---|---|---|
| CEP290-B1196 | + | UUAGAUCUUAUUCUACUCCU (902) | 20 | upstream |
| CEP290-B1197 | + | UUAGAUCUUAUUCUACUCCU (903) | 20 | upstream |
| CEP290-B1198 | − | UUCAGGAUUCCUACUAAAUU (904) | 20 | upstream |
| CEP290-B1199 | − | UUCAGGAUUCCUACUAAAUU (904) | 20 | upstream |
| CEP290-B1200 | − | UUCAUCUUCCUCAUCAGAAA (905) | 20 | upstream |
| CEP290-B1201 | + | UUGCCUAGGACUUUCUAAUG (906) | 20 | upstream |
| CEP290-B1202 | − | UUUCUGCUGCUUUUGCCAAA (907) | 20 | upstream |
| CEP290-B1203 | − | UUUCUGCUGCUUUUGCCAAA (907) | 20 | upstream |
| CEP290-B1204 | + | UUUUGACAGUUUUUAAGGCG (908) | 20 | downstream |
| CEP290-B1205 | + | UUUUUAAGGCGGGGAGUCAC (909) | 20 | downstream |
| CEP290-B1206 | + | AAAAGCUUUUGAGCUAA (910) | 17 | upstream |
| CEP290-B1207 | + | AAAGAACAUACAUAAGA (911) | 17 | downstream |
| CEP290-B1208 | + | AAAUGGUUCCCUAUAUA (912) | 17 | downstream |
| CEP290-B1209 | + | AACAACGUUUUCAUUUA (913) | 17 | upstream |
| CEP290-B1210 | + | AACCUAUGUAUAAGAUG (914) | 17 | downstream |
| CEP290-B1211 | + | AACUAAGACACUGCCAA (915) | 17 | downstream |
| CEP290-B1212 | + | AAGACUGGAGAUAGAGA (916) | 17 | downstream |
| CEP290-B1213 | + | AAGACUUAUAUUCCAUU (917) | 17 | downstream |
| CEP290-B1214 | + | AAGAUGAAAAAUACUCU (918) | 17 | upstream |
| CEP290-B1215 | − | AAGCAUACUUUUUUUAA (919) | 17 | downstream |
| CEP290-B1216 | + | AAGCCUCUAUUUCUGAU (920) | 17 | upstream |
| CEP290-B1217 | − | AAGCUUUUGCUGGCUCA (921) | 17 | upstream |
| CEP290-B1218 | + | AAGUUUUGAAACAGGAA (922) | 17 | downstream |
| CEP290-B1219 | + | ACAAGAUGUCUCUUGCC (923) | 17 | upstream |
| CEP290-B1220 | + | ACAGAGGACAUGGAGAA (924) | 17 | upstream |
| CEP290-B1221 | + | ACAGGAAUAGAAAUUCA (925) | 17 | downstream |
| CEP290-B1222 | + | ACAUGGGAGUCACAGGG (926) | 17 | downstream |
| CEP290-B1223 | − | ACGUUAUCAUUUCCCA (927) | 17 | upstream |
| CEP290-B1224 | + | ACUAAGACACUGCCAAU (603) | 17 | downstream |
| CEP290-B1225 | + | AGAAAGAACACUGUGGU (928) | 17 | downstream |
| CEP290-B1226 | + | AGACUGGAGAUAGAGAC (929) | 17 | downstream |
| CEP290-B1227 | + | AGACUUAUAUUCCAUUA (651) | 17 | downstream |
| CEP290-B1228 | − | AGAGACACAUUCAGUAA (930) | 17 | upstream |
| CEP290-B1229 | − | AGAGUUCAAGCUAAUAC (931) | 17 | downstream |
| CEP290-B1230 | − | AGAUCCUUUCACAGGAG (932) | 17 | upstream |
| CEP290-B1231 | + | AGAUGAAAAAUACUCUU (933) | 17 | upstream |

TABLE 4D-continued

| gRNA Name | DNA Strand | Targeting Domain (SEQ ID NO) | Target Site Length | Position relative to mutation |
|---|---|---|---|---|
| CEP290-B1232 | + | AGAUGACAUGAGGUAAG (934) | 17 | downstream |
| CEP290-B1233 | − | AGCAAGAGAUGAACUAG (935) | 17 | downstream |
| CEP290-B1234 | + | AGCCUCUAUUUCUGAUG (936) | 17 | upstream |
| CEP290-B1235 | + | AGGAAGAUGAACAAAUC (937) | 17 | upstream |
| CEP290-B1236 | + | AGGACUUUCUAAUGCUG (938) | 17 | upstream |
| CEP290-B1237 | + | AGGAGAUACUCAACACA (939) | 17 | downstream |
| CEP290-B1238 | + | AGGAUAGGACAGAGGAC (940) | 17 | upstream |
| CEP290-B1239 | − | AGGAUUCCUACUAAAUU (941) | 17 | upstream |
| CEP290-B1240 | − | AGGAUUCCUACUAAAUU (941) | 17 | upstream |
| CEP290-B1241 | + | AGGGUAGGAUUCAUGUU (942) | 17 | downstream |
| CEP290-B1242 | − | AGUUCAAGCUAAUACAU (943) | 17 | downstream |
| CEP290-B1243 | + | AUAAGCCUCUAUUUCUG (944) | 17 | upstream |
| CEP290-B1244 | − | AUAAGUCUUUUGAUAUA (945) | 17 | downstream |
| CEP290-B1245 | + | AUAAUUUAGUAGGAAUC (946) | 17 | upstream |
| CEP290-B1246 | + | AUAAUUUAGUAGGAAUC (946) | 17 | upstream |
| CEP290-B1247 | − | AUACCUUUUACUGAGGA (947) | 17 | upstream |
| CEP290-B1248 | − | AUAGAGGCUUAUGGAUU (948) | 17 | upstream |
| CEP290-B1249 | + | AUAGGACAGAGGACAUG (949) | 17 | upstream |
| CEP290-B1250 | − | AUAUCUGUCUUCCUUAA (950) | 17 | downstream |
| CEP290-B1251 | − | AUCAGAAAUAGAGGCUU (951) | 17 | upstream |
| CEP290-B1252 | + | AUCAUUCUUGUGGCAGU (952) | 17 | downstream |
| CEP290-B1253 | − | AUCCUCCUUACUGCCAC (953) | 17 | downstream |
| CEP290-B1254 | − | AUCUAAGAUCCUUUCAC (954) | 17 | upstream |
| CEP290-B1255 | − | AUCUUCCUCAUCAGAAA (955) | 17 | upstream |
| CEP290-B1256 | + | AUGACAUGAGGUAAGUA (656) | 17 | downstream |
| CEP290-B1257 | + | AUGACUCAUAAUUUAGU (956) | 17 | upstream |
| CEP290-B1258 | + | AUGACUCAUAAUUUAGU (956) | 17 | upstream |
| CEP290-B1259 | − | AUGAGAGUGAUUAGUGG (645) | 17 | downstream |
| CEP290-B1260 | − | AUUAGAAAGUCCUAGGC (957) | 17 | upstream |
| CEP290-B1261 | + | AUUCUUGUGGCAGUAAG (958) | 17 | downstream |
| CEP290-B1262 | + | CACUCUCAUGUAUUAGC (959) | 17 | downstream |
| CEP290-B1263 | − | CAUAUCUGUCUUCCUUA (960) | 17 | downstream |
| CEP290-B1264 | + | CAUGACUCAUAAUUUAG (961) | 17 | upstream |
| CEP290-B1265 | + | CAUGACUCAUAAUUUAG (961) | 17 | upstream |
| CEP290-B1266 | − | CAUGAGAGUGAUUAGUG (962) | 17 | downstream |
| CEP290-B1267 | + | CCUAGGACUUUCUAAUG (963) | 17 | upstream |
| CEP290-B1268 | − | CCUAUCCUCUCCAGCAU (964) | 17 | upstream |
| CEP290-B1269 | + | CUAGGACUUUCUAAUGC (965) | 17 | upstream |

TABLE 4D-continued

| gRNA Name | DNA Strand | Targeting Domain (SEQ ID NO) | Target Site Length | Position relative to mutation |
|---|---|---|---|---|
| CEP290-B1270 | − | CUCAUGUCAUCUAGAGC (966) | 17 | downstream |
| CEP290-B1271 | + | CUCUUGCUCUAGAUGAC (967) | 17 | downstream |
| CEP290-B1272 | + | CUCUUUGGCAAAAGCAG (968) | 17 | upstream |
| CEP290-B1273 | + | CUCUUUGGCAAAAGCAG (969) | 17 | upstream |
| CEP290-B1274 | + | CUGAACAAGUUUUGAAA (970) | 17 | downstream |
| CEP290-B1275 | + | CUGAGCAAAACAACUGG (971) | 17 | downstream |
| CEP290-B1276 | − | CUGCUGCUUUUGCCAAA (972) | 17 | upstream |
| CEP290-B1277 | − | CUGCUGCUUUUGCCAAA (972) | 17 | upstream |
| CEP290-B1278 | + | CUGGAGAGGAUAGGACA (973) | 17 | upstream |
| CEP290-B1279 | − | UAAAUGAAAACGUUGUU (974) | 17 | upstream |
| CEP290-B1280 | − | UAAAUGAAAACGUUGUU (974) | 17 | upstream |
| CEP290-B1281 | − | UAAGCAUACUUUUUUUA (975) | 17 | downstream |
| CEP290-B1282 | + | UAAGGAGGAUGUAAGAC (648) | 17 | downstream |
| CEP290-B1283 | + | UAAUGCCUGAACAAGUU (976) | 17 | downstream |
| CEP290-B1284 | − | UAAUUUGUUUCUGUGUG (977) | 17 | downstream |
| CEP290-B1285 | + | UACAAAAGAACAUACAU (978) | 17 | downstream |
| CEP290-B1286 | − | UAGGCAAGAGACAUCUU (979) | 17 | upstream |
| CEP290-B1287 | − | UAUAAGUCUUUUGAUAU (980) | 17 | downstream |
| CEP290-B1288 | − | UAUCUAAGAUCCUUUCA (981) | 17 | upstream |
| CEP290-B1289 | + | UAUUUCUGAUGAGGAAG (982) | 17 | upstream |
| CEP290-B1290 | + | UCACUGAGCAAAACAAC (650) | 17 | downstream |
| CEP290-B1291 | + | UCAUUCUUGUGGCAGUA (2780) | 17 | downstream |
| CEP290-B1292 | − | UCCAGUUGUUUUGCUCA (983) | 17 | downstream |
| CEP290-B1293 | + | UCUAAUGCUGGAGAGGA (984) | 17 | upstream |
| CEP290-B1294 | + | UGAACAAGUUUUGAAAC (985) | 17 | downstream |
| CEP290-B1295 | + | UGAACUCUGUGCCAAAC (638) | 17 | downstream |
| CEP290-B1296 | + | UGACAGUUUUUAAGGCG (642) | 17 | downstream |
| CEP290-B1297 | + | UGAGCCAGCAAAAGCUU (986) | 17 | upstream |
| CEP290-B1298 | + | UGCAGAACUAGUGUAGA (987) | 17 | downstream |
| CEP290-B1299 | + | UGCCAAUAGGGAUAGGU (614) | 17 | downstream |
| CEP290-B1300 | − | UGCUCUUUUCUAUAUAU (988) | 17 | downstream |
| CEP290-B1301 | + | UGCUGGAGAGGAUAGGA (989) | 17 | upstream |
| CEP290-B1302 | − | UGUCAAAUAUGGUGCUU (643) | 17 | downstream |
| CEP290-B1303 | − | UGUUUAUCAAUAUUAUU (990) | 17 | upstream |
| CEP290-B1304 | − | UGUUUAUCAAUAUUAUU (990) | 17 | upstream |
| CEP290-B1305 | + | UUAAAAAAAGUAUGCUU (991) | 17 | downstream |
| CEP290-B1306 | + | UUAAGGCGGGGAGUCAC (992) | 17 | downstream |
| CEP290-B1307 | + | UUACUGAAUGUGUCUCU (993) | 17 | upstream |

TABLE 4D-continued

| gRNA Name | DNA Strand | Targeting Domain (SEQ ID NO) | Target Site Length | Position relative to mutation |
|---|---|---|---|---|
| CEP290-B1308 | + | UUACUGAAUGUGUCUCU (993) | 17 | upstream |
| CEP290-B1309 | + | UUAUUCUACUCCUGUGA (994) | 17 | upstream |
| CEP290-B1310 | + | UUCACUGAGCAAAACAA (995) | 17 | downstream |
| CEP290-B1311 | − | UUCUGCUGCUUUUGCCA (996) | 17 | upstream |
| CEP290-B1312 | − | UUCUGCUGCUUUUGCCA (996) | 17 | upstream |
| CEP290-B1313 | + | UUGAACUCUGUGCCAAA (997) | 17 | downstream |
| CEP290-B1314 | + | UUGACAGUUUUUAAGGC (998) | 17 | downstream |
| CEP290-B1315 | − | UUGUGGAUAAUGUAUCA (999) | 17 | upstream |
| CEP290-B1316 | − | UUGUUCAUCUUCCUCAU (1000) | 17 | upstream |
| CEP290-B1317 | − | UUGUUCUGAGUAGCUUU (1001) | 17 | upstream |
| CEP290-B1318 | + | UUUGACAGUUUUUAAGG (1002) | 17 | downstream |
| CEP290-B1319 | + | UUUUGACAGUUUUUAAG (1003) | 17 | downstream |

Table 5A provides targeting domains for break-induced deletion of genomic sequence including the mutation at the LCA10 target position in the CEP290 gene selected according to the first tier parameters. The targeting domains are within 400 bp upstream of an Alu repeat or 700 bp downstream of the mutation, have good orthogonality, and start with G. It is contemplated herein that the targeting domain hybridizes to the target domain through complementary base pairing. Any of the targeting domains in the table can be used with a N. meningitidis Cas9 molecule that generates a double stranded break (Cas9 nuclease) or a single-stranded break (Cas9 nickase).

TABLE 5A

| gRNA Name | DNA Strand | Targeting Domain (SEQ ID NO) | Target Site Length | Position relative to mutation |
|---|---|---|---|---|
| CEP290-B65 | − | GAGUUCAAGCUAAUACAUGA (589) | 20 | downstream |
| CEP290-B296 | − | GUUGUUCUGAGUAGCUU (590) | 17 | upstream |
| CEP290-B308 | + | GGCAAAAGCAGCAGAAAGCA (591) | 20 | upstream |
| CEP290-B536 | − | GUUGUUCUGAGUAGCUU (590) | 17 | upstream |
| CEP290-B482 | + | GGCAAAAGCAGCAGAAAGCA (591) | 20 | upstream |

Table 5B provides targeting domains for break-induced deletion of genomic sequence including the mutation at the LCA10 target position in the CEP290 gene selected according to the second tier parameters. The targeting domains are within 400 bp upstream of an Alu repeat or 700 bp downstream of the mutation, have good orthogonality, and do not start with G. It is contemplated herein that the targeting domain hybridizes to the target domain through complementary base pairing. Any of the targeting domains in the table can be used with a N. meningitidis Cas9 molecule that generates a double stranded break (Cas9 nuclease) or a single-stranded break (Cas9 nickase).

TABLE 5B

| gRNA Name | DNA Strand | Targeting Domain (SEQ ID NO) | Target Site Length | Position relative to mutation |
|---|---|---|---|---|
| CEP290-B235 | − | UUCAAGCUAAUACAUGA (1004) | 17 | downstream |
| CEP290-B109 | + | CACAUGGGAGUCACAGG (1005) | 17 | downstream |

TABLE 5B-continued

| gRNA Name | DNA Strand | Targeting Domain (SEQ ID NO) | Target Site Length | Position relative to mutation |
|---|---|---|---|---|
| CEP290-B129 | + | AGUCACAUGGGAGUCACAGG (1006) | 20 | downstream |
| CEP290-B295 | − | AAUAGAGGCUUAUGGAU (1007) | 17 | upstream |
| CEP290-B297 | − | CUGAGGACAGAACAAGC (1008) | 17 | upstream |
| CEP290-B298 | − | CAUCAGAAAUAGAGGCU (1009) | 17 | upstream |
| CEP290-B299 | − | CUGCUUUUGCCAAAGAG (1010) | 17 | upstream |
| CEP290-B300 | + | AGCAGAAAGCAAACUGA (1011) | 17 | upstream |
| CEP290-B301 | + | AAAAGCAGCAGAAAGCA (1012) | 17 | upstream |
| CEP290-B302 | − | UUACUGAGGACAGAACAAGC (1013) | 20 | upstream |
| CEP290-B303 | − | AACGUUGUUCUGAGUAGCUU (1014) | 20 | upstream |
| CEP290-B304 | − | CUGCUGCUUUUGCCAAAGAG (1015) | 20 | upstream |
| CEP290-B305 | − | AGAAAUAGAGGCUUAUGGAU (1016) | 20 | upstream |
| CEP290-B306 | − | CCUCAUCAGAAAUAGAGGCU (1017) | 20 | upstream |
| CEP290-B307 | + | AGCAGCAGAAAGCAAACUGA (1018) | 20 | upstream |
| CEP290-B531 | − | CUGCUUUUGCCAAAGAG (1019) | 17 | upstream |
| CEP290-B522 | + | AGCAGAAAGCAAACUGA (1020) | 17 | upstream |
| CEP290-B537 | + | AAAAGCAGCAGAAAGCA (1021) | 17 | upstream |
| CEP290-B504 | − | AACGUUGUUCUGAGUAGCUU (1022) | 20 | upstream |
| CEP290-B478 | − | CUGCUGCUUUUGCCAAAGAG (1023) | 20 | upstream |
| CEP290-B526 | + | AGCAGCAGAAAGCAAACUGA (1024) | 20 | upstream |

Table 6A provides targeting domains for introduction of an indel (e.g., mediated by NHEJ) in close proximity to or including the LCA10 target position in the CEP290 gene selected according to the first tier parameters. The targeting domains are within 40 bases of the LCA10 target position, have good orthogonality, start with G and PAM is NNGRRT. It is contemplated herein that in an embodiment the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

Table 6B provides targeting domains for introduction of an indel (e.g., mediated by NHEJ) in close proximity to or including the LCA10 target position in the CEP290 gene selected according to the second tier parameters. The targeting domains are within 40 bases of the LCA10 target position, have good orthogonality, and PAM is NNGRRT. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 6A

| gRNA Name | DNA Strand | Targeting Domain | Target Site Length |
|---|---|---|---|
| cep290-12 | − | GCACCUGGCCCCAGUUGUAAUU (SEQ ID NO: 398) | 22 |

TABLE 6B

| gRNA Name | DNA Strand | Targeting Domain (SEQ ID NO) | Target Site Length |
|---|---|---|---|
| CEP290-35 | + | AAAUAAAACUAAGACACUGCCAAU (1025) | 24 |

TABLE 6B-continued

| gRNA Name | DNA Strand | Targeting Domain (SEQ ID NO) | Target Site Length |
|---|---|---|---|
| CEP290-36 | + | AAUAAAACUAAGACACUGCCAAU (1026) | 23 |
| CEP290-37 | + | AUAAAACUAAGACACUGCCAAU (1027) | 22 |
| CEP290-38 | + | AAAACUAAGACACUGCCAAU (610) | 20 |
| CEP290-39 | + | AAACUAAGACACUGCCAAU (1028) | 19 |
| CEP290-40 | + | AACUAAGACACUGCCAAU (1029) | 18 |
| CEP290-512 | – | ACCUGGCCCCAGUUGUAAUU (616) | 20 |
| CEP290-17 | – | CCGCACCUGGCCCCAGUUGUAAUU (1030) | 24 |
| CEP290-41 | – | CGCACCUGGCCCCAGUUGUAAUU (1031) | 23 |
| CEP290-42 | – | CACCUGGCCCCAGUUGUAAUU (1032) | 21 |
| CEP290-513 | – | CCUGGCCCCAGUUGUAAUU (1033) | 19 |
| CEP290-514 | – | CUGGCCCCAGUUGUAAUU (1034) | 18 |
| CEP290-43 | + | UAAAACUAAGACACUGCCAAU (1035) | 21 |

Table 6C provides targeting domains for introduction of an indel (e.g., mediated by NHEJ) in close proximity to or including the LCA10 target position in the CEP290 gene selected according to the fifth tier parameters. The targeting domains are within 40 bases of the LCA10 target position, and PAM is NNGRRV. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 6C

| gRNA Name | DNA Strand | Targeting Domain (SEQ ID NO) | Target Site Length |
|---|---|---|---|
| CEP290-44 | + | AAAAUAAAACUAAGACACUGCCAA (1036) | 24 |
| CEP290-45 | + | AAAUAAAACUAAGACACUGCCAA (1037) | 23 |
| CEP290-46 | + | AAUAAAACUAAGACACUGCCAA (1038) | 22 |
| CEP290-47 | + | AUAAAACUAAGACACUGCCAA (1039) | 21 |
| CEP290-48 | + | AAAACUAAGACACUGCCAA (1040) | 19 |
| CEP290-49 | + | AAACUAAGACACUGCCAA (1041) | 18 |
| CEP290-16 | + | AAGACACUGCCAAUAGGGAUAGGU (1042) | 24 |
| CEP290-50 | + | AGACACUGCCAAUAGGGAUAGGU (1043) | 23 |
| CEP290-51 | + | ACACUGCCAAUAGGGAUAGGU (1044) | 21 |
| CEP290-510 | + | ACUGCCAAUAGGGAUAGGU (1045) | 19 |
| CEP290-509 | + | CACUGCCAAUAGGGAUAGGU (613) | 20 |
| CEP290-511 | + | CUGCCAAUAGGGAUAGGU (1046) | 18 |
| CEP290-11 | + | GACACUGCCAAUAGGGAUAGGU (1047) | 22 |
| CEP290-52 | + | UAAAACUAAGACACUGCCAA (1048) | 20 |
| CEP290-13 | + | AUGAGAUACUCACAAUUACAAC (1049) | 22 |
| CEP290-53 | + | AGAUACUCACAAUUACAAC (1050) | 19 |
| CEP290-18 | + | GUAUGAGAUACUCACAAUUACAAC (1051) | 24 |
| CEP290-54 | + | GAGAUACUCACAAUUACAAC (395) | 20 |
| CEP290-55 | + | GAUACUCACAAUUACAAC (1052) | 18 |
| CEP290-14 | + | UAUGAGAUACUCACAAUUACAAC (1053) | 23 |
| CEP290-57 | + | UGAGAUACUCACAAUUACAAC (1054) | 21 |
| CEP290-58 | + | AUGAGAUAUUCACAAUUACAA (1055) | 21 |
| CEP290-59 | + | AGAUAUUCACAAUUACAA (1056) | 18 |
| CEP290-19 | + | GGUAUGAGAUAUUCACAAUUACAA (1057) | 24 |
| CEP290-61 | + | GUAUGAGAUAUUCACAAUUACAA (1058) | 23 |
| CEP290-63 | + | GAGAUAUUCACAAUUACAA (1059) | 19 |
| CEP290-65 | + | UAUGAGAUAUUCACAAUUACAA (1060) | 22 |
| CEP290-66 | + | UGAGAUAUUCACAAUUACAA (1061) | 20 |

Table 6D provides targeting domains for introduction of an indel (e.g., mediated by NHEJ) in close proximity to or including the LCA10 target position in the CEP290 gene that can be used for dual targeting. Any of the targeting domains in the table can be used with a S. aureus Cas9 (nickase) molecule to generate a single stranded break. Exemplary nickase pairs including selecting a targeting domain from Group A and a second targeting domain from Group B. It is contemplated herein that a targeting domain of Group A can be combined with any of the targeting domains of Group B. For example, the CEP290-12 or CEP290-17 can be combined with CEP290-11 or CEP290-16.

TABLE 6D

| Group A | Group B |
|---|---|
| CEP290-12 | CEP290-11 |
| CEP290-17 | CEP290-16 |

Table 7A provides targeting domains for break-induced deletion of genomic sequence including the mutation at the LCA10 target position in the CEP290 gene selected according to the first tier parameters. The targeting domains are within 1000 bp upstream of an Alu repeat, within 40 bp upstream of mutation, or 1000 bp downstream of the mutation, have good orthogonality, and start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 7A

| gRNA Name | DNA Strand | Targeting Domain (SEQ ID NO) | Target Site Length | Position relative to mutation |
|---|---|---|---|---|
| CEP290-67 | + | GAAAGAUGAAAAAUACUCUU (462) | 20 | upstream |
| CEP290-68 | − | GAAAUAGAUGUAGAUUG (463) | 17 | downstream |
| CEP290-70 | − | GAAAUAUUAAGGGCUCUUCC (464) | 20 | upstream |
| CEP290-71 | + | GAACAAAAGCCAGGGACCAU (465) | 20 | upstream |
| CEP290-72 | − | GAACUCUAUACCUUUUACUG (466) | 20 | upstream |
| CEP290-73 | − | GAAGAAUGGAAUAGAUAAUA (467) | 20 | downstream |
| CEP290-74 | + | GAAUAGUUUGUUCUGGGUAC (468) | 20 | upstream |
| CEP290-75 | − | GAAUGGAAUAGAUAAUA (469) | 17 | downstream |
| CEP290-76 | + | GAAUUUACAGAGUGCAUCCA (470) | 20 | upstream |
| CEP290-77 | − | GAGAAAAAGGAGCAUGAAAC (471) | 20 | upstream |
| CEP290-78 | − | GAGAGCCACAGUGCAUG (472) | 17 | downstream |
| CEP290-79 | − | GAGGUAGAAUCAAGAAG (473) | 17 | downstream |
| CEP290-80 | + | GAGUGCAUCCAUGGUCC (474) | 17 | upstream |
| CEP290-81 | + | GAUAACUACAAAGGGUC (475) | 17 | upstream |
| CEP290-82 | + | GAUAGAGACAGGAAUAA (476) | 17 | downstream |
| CEP290-83 | + | GAUGAAAAAUACUCUUU (477) | 17 | upstream |
| CEP290-84 | + | GAUGCAUGAGGUAAGU (478) | 17 | downstream |
| CEP290-85 | + | GAUGCAGAACUAGUGUAGAC (460) | 20 | downstream |
| CEP290-86 | + | GCAGAACUAGUGUAGAC (458) | 17 | downstream |
| CEP290-87 | − | GCAUGUGGUGUCAAAUA (479) | 17 | downstream |
| CEP290-88 | + | GCCUGAACAAGUUUUGAAAC (480) | 20 | downstream |
| CEP290-89 | − | GCUACCGGUUACCUGAA (457) | 17 | downstream |
| CEP290-90 | − | GCUCUUUUCUAUAUAUA (481) | 17 | downstream |
| CEP290-91 | + | GCUUGAACUCUGUGCCAAAC (461) | 20 | downstream |
| CEP290-92 | + | GCUUUUGACAGUUUUUAAGG (482) | 20 | downstream |
| CEP290-93 | − | GCUUUUGUUCCUUGGAA (483) | 17 | upstream |
| CEP290-94 | + | GGAACAAAAGCCAGGGACCA (484) | 20 | upstream |
| CEP290-95 | + | GGACUUGACUUUUACCCUUC (485) | 20 | downstream |
| CEP290-96 | + | GGAGAAUAGUUUGUUCU (486) | 17 | upstream |
| CEP290-97 | + | GGAGUCACAUGGGAGUCACA (487) | 20 | downstream |
| CEP290-98 | + | GGAUAGGACAGAGGACA (488) | 17 | upstream |
| CEP290-99 | + | GGCUGUAAGAUAACUACAAA (489) | 20 | upstream |
| CEP290-100 | + | GGGAGAAUAGUUUGUUC (490) | 17 | upstream |

TABLE 7A-continued

| gRNA Name | DNA Strand | Targeting Domain (SEQ ID NO) | Target Site Length | Position relative to mutation |
|---|---|---|---|---|
| CEP290-101 | + | GGGAGUCACAUGGGAGUCAC (491) | 20 | downstream |
| CEP290-102 | − | GGGCUCUUCCUGGACCA (492) | 17 | upstream |
| CEP290-103 | + | GGGUACAGGGGUAAGAGAAA (493) | 20 | upstream |
| CEP290-104 | − | GGUCCCUGGCUUUUGUUCCU (494) | 20 | upstream |
| CEP290-105 | − | GUAAAGGUUCAUGAGACUAG (495) | 20 | downstream |
| CEP290-106 | + | GUAACAUAAUCACCUCUCUU (496) | 20 | upstream |
| CEP290-107 | + | GUAAGACUGGAGAUAGAGAC (497) | 20 | downstream |
| CEP290-108 | + | GUACAGGGGUAAGAGAA (498) | 17 | upstream |
| CEP290-109 | + | GUAGCUUUUGACAGUUUUUA (499) | 20 | downstream |
| CEP290-110 | + | GUCACAUGGGAGUCACA (500) | 17 | downstream |
| CEP290-111 | − | GUGGAGAGCCACAGUGCAUG (501) | 20 | downstream |
| CEP290-112 | − | GUUACAAUCUGUGAAUA (502) | 17 | upstream |
| CEP290-113 | + | GUUCUGUCCUCAGUAAA (503) | 17 | upstream |
| CEP290-114 | − | GUUGAGUAUCUCCUGUU (459) | 17 | downstream |
| CEP290-115 | + | GUUUAGAAUGAUCAUUCUUG (504) | 20 | downstream |
| CEP290-116 | + | GUUUGUUCUGGGUACAG (505) | 17 | upstream |
| CEP290-117 | − | UAAAAACUGUCAAAAGCUAC (506) | 20 | downstream |
| CEP290-118 | + | UAAAAGGUAUAGAGUUCAAG (507) | 20 | upstream |
| CEP290-119 | + | UAAAUCAUGCAAGUGACCUA (508) | 20 | upstream |
| CEP290-120 | + | UAAGAUAACUACAAAGGGUC (509) | 20 | upstream |

Table 7B provides targeting domains for break-induced deletion of genomic sequence including the mutation at the LCA10 target position in the CEP290 gene selected according to the second tier parameters. The targeting domains are within 1000 bp upstream of an Alu repeat, within 40 bp upstream of mutation, or 1000 bp downstream of the mutation, have good orthogonality, and do not start with G. It is contemplated herein that the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 7B

| gRNA Name | DNA Strand | Targeting Domain (SEQ ID NO) | Target Site Length | Position relative to mutation |
|---|---|---|---|---|
| CEP290-121 | − | AAAAAGGAGCAUGAAAC (1062) | 17 | upstream |
| CEP290-122 | + | AAAACUAAGACACUGCCAAU (610) | 20 | downstream |
| CEP290-123 | + | AAAAGACUUAUAUUCCAUUA (1063) | 20 | downstream |
| CEP290-124 | − | AAAAGCUACCGGUUACCUGA (621) | 20 | downstream |
| CEP290-125 | − | AAAAUUAUGCCUAUUUAGUG (1064) | 20 | upstream |

TABLE 7B-continued

| gRNA Name | DNA Strand | Targeting Domain (SEQ ID NO) | Target Site Length | Position relative to mutation |
|---|---|---|---|---|
| CEP290-126 | + | AAACAACUGGAAGAGAGAAA (1065) | 20 | downstream |
| CEP290-127 | + | AAACUAAGACACUGCCAAUA (609) | 20 | downstream |
| CEP290-128 | − | AAACUGUCAAAAGCUAC (655) | 17 | downstream |
| CEP290-129 | − | AAAGAAAUAGAUGUAGAUUG (1066) | 20 | downstream |
| CEP290-130 | + | AAAGAUGAAAAAUACUCUUU (1067) | 20 | upstream |
| CEP290-131 | − | AAAGCUACCGGUUACCUGAA (620) | 20 | downstream |
| CEP290-133 | − | AAAUAGAGGCUUAUGGAUUU (1068) | 20 | upstream |
| CEP290-134 | + | AAAUUAUCACCACACUAAAU (1069) | 20 | upstream |
| CEP290-135 | − | AACAAACUAUUCUCCCA (1070) | 17 | upstream |
| CEP290-136 | − | AACAGUAGCUGAAAUAUUAA (1071) | 20 | upstream |
| CEP290-137 | + | AACAUGACUCAUAAUUUAGU (1072) | 20 | upstream |
| CEP290-138 | − | AACUAUUCUCCCAUGGUCCC (1073) | 20 | upstream |
| CEP290-140 | + | AAGACACUGCCAAUAGGGAU (600) | 20 | downstream |
| CEP290-141 | − | AAGGAAAUACAAAAACUGGA (1074) | 20 | downstream |
| CEP290-142 | + | AAGGUAUAGAGUUCAAG (1075) | 17 | upstream |
| CEP290-143 | − | AAGGUUCAUGAGACUAG (1076) | 17 | downstream |
| CEP290-144 | + | AAUAGUUUGUUCUGGGUACA (1077) | 20 | upstream |
| CEP290-145 | − | AAUAUAAGUCUUUUGAUAUA (1078) | 20 | downstream |
| CEP290-146 | − | AAUAUAUUAUCUAUUUAUAG (1079) | 20 | upstream |
| CEP290-147 | − | AAUAUUGUAAUCAAAGG (1080) | 17 | upstream |
| CEP290-148 | + | AAUAUUUCAGCUACUGU (1081) | 17 | upstream |
| CEP290-149 | − | AAUUAUUGUUGCUUUUUGAG (1082) | 20 | downstream |
| CEP290-150 | + | AAUUCACUGAGCAAAACAAC (1083) | 20 | downstream |
| CEP290-151 | + | ACAAAAGCCAGGGACCA (1084) | 17 | upstream |
| CEP290-152 | + | ACACUGCCAAUAGGGAU (595) | 17 | downstream |
| CEP290-153 | + | ACAGAGUGCAUCCAUGGUCC (1085) | 20 | upstream |
| CEP290-154 | + | ACAUAAUCACCUCUCUU (1086) | 17 | upstream |
| CEP290-155 | − | ACCAGACAUCUAAGAGAAAA (1087) | 20 | upstream |
| CEP290-156 | − | ACGUGCUCUUUUCUAUAUAU (622) | 20 | downstream |

TABLE 7B-continued

| gRNA Name | DNA Strand | Targeting Domain (SEQ ID NO) | Target Site Length | Position relative to mutation |
|---|---|---|---|---|
| CEP290-157 | + | ACUUUCUAAUGCUGGAG (1088) | 17 | upstream |
| CEP290-158 | + | ACUUUUACCCUUCAGGUAAC (626) | 20 | downstream |
| CEP290-159 | − | AGAAUAUUGUAAUCAAAGGA (1089) | 20 | upstream |
| CEP290-160 | − | AGACAUCUAAGAGAAAA (1090) | 17 | upstream |
| CEP290-161 | + | AGACUUAUAUUCCAUUA (651) | 17 | downstream |
| CEP290-162 | + | AGAGGAUAGGACAGAGGACA (1091) | 20 | upstream |
| CEP290-163 | + | AGAUGACAUGAGGUAAGUAG (1092) | 20 | downstream |
| CEP290-164 | + | AGAUGUCUGGUUAAAAG (1093) | 17 | upstream |
| CEP290-165 | + | AGCCUCUAUUUCUGAUG (1094) | 17 | upstream |
| CEP290-166 | − | AGCUACCGGUUACCUGA (618) | 17 | downstream |
| CEP290-167 | − | AGCUCAAAAGCUUUUGC (1095) | 17 | upstream |
| CEP290-168 | − | AGGAAAUACAAAAACUGGAU (1096) | 20 | downstream |
| CEP290-169 | + | AGGAAGAUGAACAAAUC (1097) | 17 | upstream |
| CEP290-170 | + | AGGACAGAGGACAUGGAGAA (1098) | 20 | upstream |
| CEP290-171 | + | AGGACUUUCUAAUGCUGGAG (1099) | 20 | upstream |
| CEP290-172 | − | AGGCAAGAGACAUCUUG (1100) | 17 | upstream |
| CEP290-173 | − | AGGUAGAAUAUUGUAAUCAA (1101) | 20 | upstream |
| CEP290-174 | − | AGUAGCUGAAAUAUUAA (1102) | 17 | upstream |
| CEP290-175 | + | AGUCACAUGGGAGUCAC (644) | 17 | downstream |
| CEP290-176 | − | AGUGCAUGUGGUGUCAAAUA (627) | 20 | downstream |
| CEP290-177 | + | AGUUUGUUCUGGGUACA (1103) | 17 | upstream |
| CEP290-178 | + | AUAAGCCUCUAUUUCUGAUG (1104) | 20 | upstream |
| CEP290-179 | − | AUAAGUCUUUUGAUAUA (1105) | 17 | downstream |
| CEP290-180 | + | AUACAUAAGAAAGAACACUG (1106) | 20 | downstream |
| CEP290-181 | + | AUAGUUUGUUCUGGGUACAG (1107) | 20 | upstream |
| CEP290-182 | − | AUAUCUGUCUUCCUUAA (1108) | 17 | downstream |
| CEP290-183 | − | AUAUUAAGGGCUCUUCC (1109) | 17 | upstream |
| CEP290-184 | − | AUAUUGUAAUCAAAGGA (1110) | 17 | upstream |
| CEP290-185 | + | AUCAUGCAAGUGACCUA (1111) | 17 | upstream |
| CEP290-186 | − | AUCUAAGAUCCUUUCAC (1112) | 17 | upstream |
| CEP290-187 | − | AUCUUCCUCAUCAGAAAUAG (1113) | 20 | upstream |
| CEP290-188 | + | AUGACAUGAGGUAAGUA (656) | 17 | downstream |

TABLE 7B-continued

| gRNA Name | DNA Strand | Targeting Domain (SEQ ID NO) | Target Site Length | Position relative to mutation |
|---|---|---|---|---|
| CEP290-189 | + | AUGACUCAUAAUUUAGU (1114) | 17 | upstream |
| CEP290-190 | − | AUGAGAGUGAUUAGUGG (645) | 17 | downstream |
| CEP290-191 | + | AUGAGGAAGAUGAACAAAUC (1115) | 20 | upstream |
| CEP290-192 | + | AUGGGAGAAUAGUUUGUUCU (1116) | 20 | upstream |
| CEP290-193 | − | AUUAGCUCAAAAGCUUUUGC (633) | 20 | upstream |
| CEP290-194 | − | AUUAUGCCUAUUUAGUG (1117) | 17 | upstream |
| CEP290-195 | + | AUUCCAAGGAACAAAAGCCA (1118) | 20 | upstream |
| CEP290-196 | − | AUUGAGGUAGAAUCAAGAAG (1119) | 20 | downstream |
| CEP290-197 | + | AUUUGACACCACAUGCACUG (623) | 20 | downstream |
| CEP290-198 | + | CAAAAGCCAGGGACCAU (1120) | 17 | upstream |
| CEP290-199 | − | CAACAGUAGCUGAAAUAUUA (1121) | 20 | upstream |
| CEP290-200 | + | CAAGAUGUCUCUUGCCU (1122) | 17 | upstream |
| CEP290-201 | − | CAGAACAAACUAUUCUCCCA (1123) | 20 | upstream |
| CEP290-202 | − | CAGAUUUCAUGUGUGAAGAA (1124) | 20 | downstream |
| CEP290-204 | − | CAGCAUUAGAAAGUCCU (1125) | 17 | upstream |
| CEP290-205 | + | CAGGGGUAAGAGAAAGGGAU (1126) | 20 | upstream |
| CEP290-206 | + | CAGUAAGGAGGAUGUAAGAC (1127) | 20 | downstream |
| CEP290-207 | − | CAGUAGCUGAAAUAUUA (1128) | 17 | upstream |
| CEP290-208 | + | CAUAAGAAAGAACACUG (1129) | 17 | downstream |
| CEP290-209 | + | CAUGGGAGAAUAGUUUGUUC (1130) | 20 | upstream |
| CEP290-210 | + | CAUGGGAGUCACAGGGU (652) | 17 | downstream |
| CEP290-211 | + | CAUUCCAAGGAACAAAAGCC (1131) | 20 | upstream |
| CEP290-212 | + | CCACAAGAUGUCUCUUGCCU (630) | 20 | upstream |
| CEP290-213 | − | CCUAGGCAAGAGACAUCUUG (631) | 20 | upstream |
| CEP290-214 | − | CGUGCUCUUUUCUAUAUAUA (624) | 20 | downstream |
| CEP290-215 | − | CGUUGUUCUGAGUAGCUUUC (629) | 20 | upstream |
| CEP290-216 | + | CUAAGACACUGCCAAUA (597) | 17 | downstream |
| CEP290-217 | + | CUAAUGCUGGAGAGGAU (1132) | 17 | upstream |
| CEP290-218 | + | CUAGAUGACAUGAGGUAAGU (1133) | 20 | downstream |
| CEP290-219 | + | CUAGGACUUUCUAAUGC (1134) | 17 | upstream |
| CEP290-220 | − | CUCAUACCUAUCCCUAU (594) | 17 | downstream |

TABLE 7B-continued

| gRNA Name | DNA Strand | Targeting Domain (SEQ ID NO) | Target Site Length | Position relative to mutation |
|---|---|---|---|---|
| CEP290-221 | - | CUCCAGCAUUAGAAAGUCCU (1135) | 20 | upstream |
| CEP290-222 | - | CUCUAUACCUUUUACUG (1136) | 17 | upstream |
| CEP290-223 | + | CUCUUGCUCUAGAUGACAUG (1137) | 20 | downstream |
| CEP290-224 | - | CUGCUGCUUUUGCCAAAGAG (1138) | 20 | upstream |
| CEP290-225 | - | CUGCUUUUGCCAAAGAG (1139) | 17 | upstream |
| CEP290-226 | - | CUGGCUUUUGUUCCUUGGAA (1140) | 20 | upstream |
| CEP290-227 | + | CUGUAAGAUAACUACAA (1141) | 17 | upstream |
| CEP290-228 | - | CUUAAGCAUACUUUUUUUAA (1142) | 20 | downstream |
| CEP290-229 | + | CUUAAUAUUUCAGCUACUGU (1143) | 20 | upstream |
| CEP290-231 | + | CUUAGAUGUCUGGUUAAAAG (1144) | 20 | upstream |
| CEP290-232 | - | CUUAUCUAAGAUCCUUUCAC (1145) | 20 | upstream |
| CEP290-233 | + | CUUGACUUUUACCCUUC (649) | 17 | downstream |
| CEP290-234 | + | CUUGUUCUGUCCUCAGUAAA (1146) | 20 | upstream |
| CEP290-235 | + | CUUUUGACAGUUUUUAAGGC (1147) | 20 | downstream |

Table 7C provides targeting domains for break-induced deletion of genomic sequence including the mutation at the LCA10 target position in the CEP290 gene selected according to the third tier parameters. The targeting domains are within 1000 bp upstream of an Alu repeat, within 40 bp upstream of mutation, or 1000 bp downstream of the mutation, and start with G. It is contemplated herein that the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase).

TABLE 7C

| gRNA Name | DNA Strand | Targeting Domain (SEQ ID NO) | Target Site Length | Position relative to mutation |
|---|---|---|---|---|
| CEP290-236 | - | GAAAUACAAAAACUGGA (1148) | 17 | downstream |
| CEP290-237 | + | GCUUUUGACAGUUUUUA (634) | 17 | downstream |
| CEP290-238 | + | GGAGAUAGAGACAGGAAUAA (635) | 20 | downstream |
| CEP290-239 | - | GGAGUGCAGUGGAGUGAUCU (1149) | 20 | downstream |
| CEP290-240 | + | GGGGUAAGAGAAAGGGA (1150) | 17 | upstream |
| CEP290-241 | + | GGGUAAGAGAAAGGGAU (1151) | 17 | upstream |
| CEP290-242 | - | GUCUCACUGUGUUGCCC (1152) | 17 | downstream |
| CEP290-243 | - | GUGCAGUGGAGUGAUCU (1153) | 17 | downstream |

TABLE 7C-continued

| gRNA Name | DNA Strand | Targeting Domain (SEQ ID NO) | Target Site Length | Position relative to mutation |
|---|---|---|---|---|
| CEP290-244 | + | GUGUGUGUGUGUGUGUUAUG (1154) | 20 | upstream |
| CEP290-245 | + | GUGUGUGUGUGUUAUGU (1155) | 17 | upstream |

Table 7D provides targeting domains for break-induced deletion of genomic sequence including the mutation at the LCA10 target position in the CEP290 gene selected according to the fourth tier parameters. The targeting domains are within 1000 bp upstream of an Alu repeat, within 40 bp upstream of mutation, or 1000 bp downstream of the mutation, and do not start with G. It is contemplated herein that the targeting domain hybridizes to the target domain through complementary base pairing. Any of the targeting domains in the table can be used with a S. pyogenes Cas9 molecule that generates a double stranded break (Cas9 nuclease) or a single-stranded break (Cas9 nickase).

TABLE 7D

| gRNA Name | DNA Strand | Targeting Domain (SEQ ID NO) | Target Site Length | Position relative to mutation |
|---|---|---|---|---|
| CEP290-246 | − | AAAUACAAAAACUGGAU (1156) | 17 | downstream |
| CEP290-247 | − | AAGCAUACUUUUUUUAA (1157) | 17 | downstream |
| CEP290-248 | + | AAGGCGGGGAGUCACAU (636) | 17 | downstream |
| CEP290-249 | + | AAGUAUGCUUAAGAAAAAA (1158) | 20 | downstream |
| CEP290-250 | + | ACAGAGGACAUGGAGAA (1159) | 17 | upstream |
| CEP290-251 | + | ACAGGGGUAAGAGAAAGGGA (1160) | 20 | upstream |
| CEP290-253 | + | ACUAAGACACUGCCAAU (603) | 17 | downstream |
| CEP290-254 | + | ACUCCACUGCACUCCAGCCU (1161) | 20 | downstream |
| CEP290-255 | + | AGACUGGAGAUAGAGAC (1162) | 17 | downstream |
| CEP290-256 | − | AGAGUCUCACUGUGUUGCCC (1163) | 20 | downstream |
| CEP290-257 | + | AGAUGAAAAAUACUCUU (1164) | 17 | upstream |
| CEP290-258 | − | AUAUUAUCUAUUUAUAG (1165) | 17 | upstream |
| CEP290-259 | − | AUUUCAUGUGUGAAGAA (1166) | 17 | downstream |
| CEP290-260 | − | AUUUUUUAUUAUCUUUAUUG (1167) | 20 | downstream |
| CEP290-261 | + | CAACUGGAAGAGAGAAA (1168) | 17 | downstream |
| CEP290-262 | + | CACUCCACUGCACUCCAGCC (1169) | 20 | downstream |
| CEP290-263 | − | CACUGUGUUGCCCAGGC (1170) | 17 | downstream |
| CEP290-264 | + | CCAAGGAACAAAAGCCA (1171) | 17 | upstream |
| CEP290-265 | + | CCACUGCACUCCAGCCU (1172) | 17 | downstream |
| CEP290-266 | − | CCCAGGCUGGAGUGCAG (1173) | 17 | downstream |
| CEP290-267 | − | CCCUGGCUUUUGUUCCU (1174) | 17 | upstream |
| CEP290-268 | + | CGCUUGAACCUGGGAGGCAG (1175) | 20 | downstream |
| CEP290-269 | − | UAAGGAAAUACAAAAAC (1176) | 17 | downstream |
| CEP290-270 | − | UAAUAAGGAAAUACAAAAAC (1177) | 20 | downstream |

TABLE 7D-continued

| gRNA Name | DNA Strand | Targeting Domain (SEQ ID NO) | Target Site Length | Position relative to mutation |
|---|---|---|---|---|
| CEP290-271 | − | UACUGCAACCUCUGCCUCCC (1178) | 20 | downstream |
| CEP290-272 | + | UAUGCUUAAGAAAAAAA (1179) | 17 | downstream |
| CEP290-273 | + | UCAUUCUUGUGGCAGUAAGG (1180) | 20 | downstream |
| CEP290-274 | + | UCCACUGCACUCCAGCC (1181) | 17 | downstream |
| CEP290-275 | − | UCUCACUGUGUUGCCCAGGC (1182) | 20 | downstream |
| CEP290-276 | + | UGAACAAGUUUUGAAAC (1183) | 17 | downstream |
| CEP290-277 | − | UGCAACCUCUGCCUCCC (1184) | 17 | downstream |
| CEP290-278 | + | UGUGUGUGUGUGUGUUAUGU (1185) | 20 | upstream |
| CEP290-279 | + | UGUGUGUGUGUGUUAUG (1186) | 17 | upstream |
| CEP290-280 | + | UUCUUGUGGCAGUAAGG (1187) | 17 | downstream |
| CEP290-281 | + | UUGAACCUGGGAGGCAG (1188) | 17 | downstream |
| CEP290-282 | − | UUGCCCAGGCUGGAGUGCAG (1189) | 20 | downstream |
| CEP290-283 | − | UUUUAUUAUCUUUAUUG (1190) | 17 | downstream |

Table 8A provides targeting domains for break-induced deletion of genomic sequence including the mutation at the LCA10 target position in the CEP290 gene selected according to the first tier parameters. The targeting domains are within 1000 bp upstream of an Alu repeat, within 40 bp upstream of mutation, or 1000 bp downstream of the mutation, have good orthogonality, start with G and PAM is NNGRRT. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 8A

| 1st Tier gRNA Name | DNA Strand | Targeting Domain (SEQ ID NO) | Target Site Length | Position relative to mutation |
|---|---|---|---|---|
| CEP290-284 | + | GCUAAAUCAUGCAAGUGACCUAAG (511) | 24 | upstream |
| CEP290-487 | − | GGUCACUUGCAUGAUUUAG (512) | 19 | upstream |
| CEP290-486 | − | GUCACUUGCAUGAUUUAG (513) | 18 | upstream |
| CEP290-285 | + | GCCUAGGACUUUCUAAUGCUGGA (514) | 23 | upstream |
| CEP290-479 | + | GGACUUUCUAAUGCUGGA (515) | 18 | upstream |
| CEP290-286 | + | GGGACCAUGGGAGAAUAGUUUGUU (516) | 24 | upstream |
| CEP290-287 | + | GGACCAUGGGAGAAUAGUUUGUU (517) | 23 | upstream |
| CEP290-288 | + | GACCAUGGGAGAAUAGUUUGUU (518) | 22 | upstream |
| CEP290-289 | − | GGUCCCUGGCUUUUGUUCCUUGGA (519) | 24 | upstream |
| CEP290-290 | − | GUCCCUGGCUUUUGUUCCUUGGA (520) | 23 | upstream |

TABLE 8A-continued

| 1st Tier gRNA Name | DNA Strand | Targeting Domain (SEQ ID NO) | Target Site Length | Position relative to mutation |
|---|---|---|---|---|
| CEP290-374 | − | GAAAACGUUGUUCUGAGUAGCUUU (521) | 24 | upstream |
| CEP290-478 | − | GUUGUUCUGAGUAGCUUU (522) | 18 | upstream |
| CEP290-489 | − | GGUCCCUGGCUUUUGUUCCU (494) | 20 | upstream |
| CEP290-488 | − | GUCCCUGGCUUUUGUUCCU (523) | 19 | upstream |
| CEP290-291 | − | GACAUCUUGUGGAUAAUGUAUCA (524) | 23 | upstream |
| CEP290-292 | − | GUCCUAGGCAAGAGACAUCUU (525) | 21 | upstream |
| CEP290-293 | + | GCCAGCAAAAGCUUUUGAGCUAA (526) | 23 | upstream |
| CEP290-481 | + | GCAAAAGCUUUUGAGCUAA (527) | 19 | upstream |
| CEP290-294 | + | GAUCUUAUUCUACUCCUGUGA (528) | 21 | upstream |
| CEP290-295 | − | GCUUUCAGGAUUCCUACUAAAUU (529) | 23 | upstream |
| CEP290-323 | + | GUUCUGUCCUCAGUAAAAGGUA (530) | 22 | upstream |
| CEP290-480 | + | GAACAACGUUUUCAUUUA (531) | 18 | upstream |
| CEP290-296 | − | GUAGAAUAUCAUAAGUUACAAUCU (532) | 24 | upstream |
| CEP290-297 | − | GAAUAUCAUAAGUUACAAUCU (533) | 21 | upstream |
| CEP290-298 | + | GUGGCUGUAAGAUAACUACA (534) | 20 | upstream |
| CEP290-299 | + | GGCUGUAAGAUAACUACA (535) | 18 | upstream |
| CEP290-300 | − | GUUUAACGUUAUCAUUUUCCCA (536) | 22 | upstream |
| CEP290-301 | + | GUAAGAGAAAGGGAUGGGCACUUA (537) | 24 | upstream |
| CEP290-492 | + | GAGAAAGGGAUGGGCACUUA (538) | 20 | upstream |
| CEP290-491 | + | GAAAGGGAUGGGCACUUA (539) | 18 | upstream |
| CEP290-483 | − | GUAAAUGAAAACGUUGUU (540) | 18 | upstream |
| CEP290-302 | + | GAUAAACAUGACUCAUAAUUUAGU (541) | 24 | upstream |
| CEP290-303 | + | GGAACAAAAGCCAGGGACCAUGG (542) | 23 | upstream |
| CEP290-304 | + | GAACAAAAGCCAGGGACCAUGG (543) | 22 | upstream |
| CEP290-305 | + | GGGAGAAUAGUUUGUUCUGGGUAC (544) | 24 | upstream |
| CEP290-306 | + | GGAGAAUAGUUUGUUCUGGGUAC (545) | 23 | upstream |
| CEP290-307 | + | GAGAAUAGUUUGUUCUGGGUAC (546) | 22 | upstream |
| CEP290-490 | + | GAAUAGUUUGUUCUGGGUAC (468) | 20 | upstream |
| CEP290-482 | − | GAAAUAGAGGCUUAUGGAUU (547) | 20 | upstream |
| CEP290-308 | + | GUUCUGGGUACAGGGGUAAGAGAA (548) | 24 | upstream |
| CEP290-494 | + | GGGUACAGGGGUAAGAGAA (549) | 19 | upstream |

TABLE 8A-continued

| 1st Tier gRNA Name | DNA Strand | Targeting Domain (SEQ ID NO) | Target Site Length | Position relative to mutation |
|---|---|---|---|---|
| CEP290-493 | + | GGUACAGGGGUAAGAGAA (550) | 18 | upstream |
| CEP290-309 | − | GUAAAUUCUCAUCAUUUUUAUUG (551) | 24 | upstream |
| CEP290-310 | + | GGAGAGGAUAGGACAGAGGACAUG (552) | 24 | upstream |
| CEP290-311 | + | GAGAGGAUAGGACAGAGGACAUG (553) | 23 | upstream |
| CEP290-313 | + | GAGGAUAGGACAGAGGACAUG (554) | 21 | upstream |
| CEP290-485 | + | GGAUAGGACAGAGGACAUG (555) | 19 | upstream |
| CEP290-484 | + | GAUAGGACAGAGGACAUG (556) | 18 | upstream |
| CEP290-314 | − | GAAUAAAUGUAGAAUUUUAAUG (557) | 22 | upstream |
| CEP290-64 | − | GUCAAAAGCUACCGGUUACCUG (558) | 22 | downstream |
| CEP290-315 | + | GUUUUUAAGGCGGGGAGUCACAU (559) | 23 | downstream |
| CEP290-203 | − | GUCUUACAUCCUCCUUACUGCCAC (560) | 24 | downstream |
| CEP290-316 | + | GAGUCACAGGGUAGGAUUCAUGUU (561) | 24 | downstream |
| CEP290-317 | + | GUCACAGGGUAGGAUUCAUGUU (562) | 22 | downstream |
| CEP290-318 | − | GGCACAGAGUUCAAGCUAAUACAU (563) | 24 | downstream |
| CEP290-319 | − | GCACAGAGUUCAAGCUAAUACAU (564) | 23 | downstream |
| CEP290-505 | − | GAGUUCAAGCUAAUACAU (565) | 18 | downstream |
| CEP290-496 | + | GAUGCAGAACUAGUGUAGAC (460) | 20 | downstream |
| CEP290-320 | − | GUGUUGAGUAUCUCCUGUUUGGCA (566) | 24 | downstream |
| CEP290-321 | − | GUUGAGUAUCUCCUGUUUGGCA (567) | 22 | downstream |
| CEP290-504 | − | GAGUAUCUCCUGUUUGGCA (568) | 19 | downstream |
| CEP290-322 | − | GAAAAUCAGAUUUCAUGUGUG (569) | 21 | downstream |
| CEP290-324 | − | GCCACAAGAAUGAUCAUUCUAAAC (570) | 24 | downstream |
| CEP290-325 | + | GGCGGGGAGUCACAUGGGAGUCA (571) | 23 | downstream |
| CEP290-326 | + | GCGGGGAGUCACAUGGGAGUCA (572) | 22 | downstream |
| CEP290-499 | + | GGGGAGUCACAUGGGAGUCA (573) | 20 | downstream |
| CEP290-498 | + | GGGAGUCACAUGGGAGUCA (574) | 19 | downstream |
| CEP290-497 | + | GGAGUCACAUGGGAGUCA (575) | 18 | downstream |
| CEP290-327 | + | GCUUUUGACAGUUUUUAAGGCG (576) | 22 | downstream |
| CEP290-328 | + | GAUCAUUCUUGUGGCAGUAAG (577) | 21 | downstream |
| CEP290-329 | − | GAGCAAGAGAUGAACUAG (578) | 18 | downstream |

TABLE 8A-continued

| 1st Tier gRNA Name | DNA Strand | Targeting Domain (SEQ ID NO) | Target Site Length | Position relative to mutation |
|---|---|---|---|---|
| CEP290-500 | + | GCCUGAACAAGUUUUGAAAC (480) | 20 | downstream |
| CEP290-330 | − | GUAGAUUGAGGUAGAAUCAAGAA (579) | 23 | downstream |
| CEP290-506 | − | GAUUGAGGUAGAAUCAAGAA (580) | 20 | downstream |
| CEP290-331 | + | GGAUGUAAGACUGGAGAUAGAGAC (581) | 24 | downstream |
| CEP290-332 | + | GAUGUAAGACUGGAGAUAGAGAC (582) | 23 | downstream |
| CEP290-503 | + | GUAAGACUGGAGAUAGAGAC (497) | 20 | downstream |
| CEP290-333 | + | GGGAGUCACAUGGGAGUCACAGGG (583) | 24 | downstream |
| CEP290-334 | + | GGAGUCACAUGGGAGUCACAGGG (584) | 23 | downstream |
| CEP290-335 | + | GAGUCACAUGGGAGUCACAGGG (585) | 22 | downstream |
| CEP290-502 | + | GUCACAUGGGAGUCACAGGG (586) | 20 | downstream |
| CEP290-336 | − | GUUUACAUAUCUGUCUUCCUUAA (587) | 23 | downstream |
| CEP290-507 | − | GAUUUCAUGUGUGAAGAA (588) | 18 | downstream |

Table 8B provides targeting domains for break-induced deletion of genomic sequence including the mutation at the LCA10 target position in the CEP290 gene selected according to the second tier parameters. The targeting domains are within 1000 bp upstream of an Alu repeat, within 40 bp upstream of mutation, or 1000 bp downstream of the mutation, and have good orthogonality. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 8B

| gRNA Name | DNA Strand | Targeting Domain (SEQ ID NO) | Target Site Length | Position relative to mutation |
|---|---|---|---|---|
| CEP290-337 | + | AAAUCAUGCAAGUGACCUAAG (1191) | 21 | upstream |
| CEP290-338 | + | AAUCAUGCAAGUGACCUAAG (1192) | 20 | upstream |
| CEP290-339 | + | AUCAUGCAAGUGACCUAAG (1193) | 19 | upstream |
| CEP290-340 | − | AGGUCACUUGCAUGAUUUAG (1194) | 20 | upstream |
| CEP290-341 | − | AAUAUUAAGGGCUCUUCCUGGACC (1195) | 24 | upstream |
| CEP290-342 | − | AUAUUAAGGGCUCUUCCUGGACC (1196) | 23 | upstream |
| CEP290-343 | − | AUUAAGGGCUCUUCCUGGACC (1197) | 21 | upstream |
| CEP290-344 | − | AAGGGCUCUUCCUGGACC (1198) | 18 | upstream |
| CEP290-345 | + | AGGACUUUCUAAUGCUGGA (1199) | 19 | upstream |
| CEP290-346 | + | ACCAUGGGAGAAUAGUUUGUU (1200) | 21 | upstream |
| CEP290-347 | + | AUGGGAGAAUAGUUUGUU (1201) | 18 | upstream |
| CEP290-348 | + | ACUCCUGUGAAAGGAUCUUAGAU (1202) | 23 | upstream |

TABLE 8B-continued

| gRNA Name | DNA Strand | Targeting Domain (SEQ ID NO) | Target Site Length | Position relative to mutation |
|---|---|---|---|---|
| CEP290-349 | − | AAAACGUUGUUCUGAGUAGCUUU (1203) | 23 | upstream |
| CEP290-350 | − | AAACGUUGUUCUGAGUAGCUUU (1204) | 22 | upstream |
| CEP290-351 | − | AACGUUGUUCUGAGUAGCUUU (1205) | 21 | upstream |
| CEP290-352 | − | ACGUUGUUCUGAGUAGCUUU (1206) | 20 | upstream |
| CEP290-353 | − | AUUUAUAGUGGCUGAAUGACUU (1207) | 22 | upstream |
| CEP290-354 | − | AUAGUGGCUGAAUGACUU (1208) | 18 | upstream |
| CEP290-355 | − | AUGGUCCCUGGCUUUUGUUCCU (1209) | 22 | upstream |
| CEP290-356 | − | AGACAUCUUGUGGAUAAUGUAUCA (1210) | 24 | upstream |
| CEP290-357 | − | ACAUCUUGUGGAUAAUGUAUCA (1211) | 22 | upstream |
| CEP290-358 | − | AUCUUGUGGAUAAUGUAUCA (1212) | 20 | upstream |
| CEP290-359 | − | AAAGUCCUAGGCAAGAGACAUCUU (1213) | 24 | upstream |
| CEP290-360 | − | AAGUCCUAGGCAAGAGACAUCUU (1214) | 23 | upstream |
| CEP290-361 | − | AGUCCUAGGCAAGAGACAUCUU (1215) | 22 | upstream |
| CEP290-362 | + | AGCCAGCAAAAGCUUUUGAGCUAA (1216) | 24 | upstream |
| CEP290-363 | + | AGCAAAAGCUUUUGAGCUAA (1217) | 20 | upstream |
| CEP290-364 | + | AGAUCUUAUUCUACUCCUGUGA (1218) | 22 | upstream |
| CEP290-365 | + | AUCUUAUUCUACUCCUGUGA (1219) | 20 | upstream |
| CEP290-366 | − | AUCUAAGAUCCUUUCACAGGAG (1220) | 22 | upstream |
| CEP290-369 | − | AAGAUCCUUUCACAGGAG (1221) | 18 | upstream |
| CEP290-370 | − | AGCUUUCAGGAUUCCUACUAAAUU (1222) | 24 | upstream |
| CEP290-371 | + | ACUCAGAACAACGUUUUCAUUUA (1223) | 23 | upstream |
| CEP290-372 | + | AGAACAACGUUUUCAUUUA (1224) | 19 | upstream |
| CEP290-373 | − | AGAAUAUCAUAAGUUACAAUCU (1225) | 22 | upstream |
| CEP290-375 | − | AAUAUCAUAAGUUACAAUCU (1226) | 20 | upstream |
| CEP290-376 | − | AUAUCAUAAGUUACAAUCU (1227) | 19 | upstream |
| CEP290-377 | + | AAGUGGCUGUAAGAUAACUACA (1228) | 22 | upstream |
| CEP290-378 | + | AGUGGCUGUAAGAUAACUACA (1229) | 21 | upstream |
| CEP290-379 | − | AUGUUUAACGUUAUCAUUUUCCCA (1230) | 24 | upstream |
| CEP290-380 | − | AACGUUAUCAUUUUCCCA (1231) | 18 | upstream |

TABLE 8B-continued

| gRNA Name | DNA Strand | Targeting Domain (SEQ ID NO) | Target Site Length | Position relative to mutation |
|---|---|---|---|---|
| CEP290-381 | + | AAGAGAAAGGGAUGGGCACUUA (1232) | 22 | upstream |
| CEP290-382 | + | AGAGAAAGGGAUGGGCACUUA (1233) | 21 | upstream |
| CEP290-383 | + | AGAAAGGGAUGGGCACUUA (1234) | 19 | upstream |
| CEP290-384 | − | AUUCAGUAAAUGAAAACGUUGUU (1235) | 23 | upstream |
| CEP290-385 | − | AGUAAAUGAAAACGUUGUU (1236) | 19 | upstream |
| CEP290-386 | + | AUAAACAUGACUCAUAAUUUAGU (1237) | 23 | upstream |
| CEP290-387 | + | AAACAUGACUCAUAAUUUAGU (1238) | 21 | upstream |
| CEP290-388 | + | AACAUGACUCAUAAUUUAGU (1239) | 20 | upstream |
| CEP290-389 | + | ACAUGACUCAUAAUUUAGU (1240) | 19 | upstream |
| CEP290-390 | − | AUUCUUAUCUAAGAUCCUUUCAC (1241) | 23 | upstream |
| CEP290-391 | + | AGGAACAAAAGCCAGGGACCAUGG (1242) | 24 | upstream |
| CEP290-392 | + | AACAAAAGCCAGGGACCAUGG (1243) | 21 | upstream |
| CEP290-393 | + | ACAAAAGCCAGGGACCAUGG (1244) | 20 | upstream |
| CEP290-394 | + | AAAAGCCAGGGACCAUGG (1245) | 18 | upstream |
| CEP290-395 | + | AGAAUAGUUUGUUCUGGGUAC (1246) | 21 | upstream |
| CEP290-396 | + | AAUAGUUUGUUCUGGGUAC (1247) | 19 | upstream |
| CEP290-397 | + | AUAGUUUGUUCUGGGUAC (1248) | 18 | upstream |
| CEP290-398 | − | AUCAGAAAUAGAGGCUUAUGGAUU (1249) | 24 | upstream |
| CEP290-399 | − | AGAAAUAGAGGCUUAUGGAUU (1250) | 21 | upstream |
| CEP290-400 | − | AAAUAGAGGCUUAUGGAUU (1251) | 19 | upstream |
| CEP290-401 | − | AAUAGAGGCUUAUGGAUU (1252) | 18 | upstream |
| CEP290-402 | − | AUAUUAUCUAUUUAUAGUGG (1253) | 23 | upstream |
| CEP290-403 | − | AUAUAUUAUCUAUUUAUAGUGG (1254) | 22 | upstream |
| CEP290-404 | − | AUAUUAUCUAUUUAUAGUGG (1255) | 20 | upstream |
| CEP290-405 | − | AUUAUCUAUUUAUAGUGG (1256) | 18 | upstream |
| CEP290-406 | − | AAAUUCUCAUCAUUUUUAUUG (1257) | 22 | upstream |
| CEP290-407 | − | AAUUCUCAUCAUUUUUAUUG (1258) | 21 | upstream |
| CEP290-408 | − | AUUCUCAUCAUUUUUAUUG (1259) | 20 | upstream |
| CEP290-409 | + | AGAGGAUAGGACAGAGGACAUG (1260) | 22 | upstream |
| CEP290-410 | + | AGGAUAGGACAGAGGACAUG (1261) | 20 | upstream |
| CEP290-411 | − | AGAAUAAAUGUAGAAUUUUAAUG (1262) | 23 | upstream |
| CEP290-412 | − | AAUAAAUGUAGAAUUUUAAUG (1263) | 21 | upstream |

TABLE 8B-continued

| gRNA Name | DNA Strand | Targeting Domain (SEQ ID NO) | Target Site Length | Position relative to mutation |
|---|---|---|---|---|
| CEP290-413 | − | AUAAAUGUAGAAUUUUAAUG (1264) | 20 | upstream |
| CEP290-414 | − | AAAUGUAGAAUUUUAAUG (1265) | 18 | upstream |
| CEP290-415 | − | AUUUUUAUUGUAGAAUAAAUG (1266) | 22 | upstream |
| CEP290-416 | + | CUAAAUCAUGCAAGUGACCUAAG (1267) | 23 | upstream |
| CEP290-417 | − | CCUUAGGUCACUUGCAUGAUUUAG (1268) | 24 | upstream |
| CEP290-418 | − | CUUAGGUCACUUGCAUGAUUUAG (1269) | 23 | upstream |
| CEP290-419 | + | CCUAGGACUUUCUAAUGCUGGA (1270) | 22 | upstream |
| CEP290-420 | + | CUAGGACUUUCUAAUGCUGGA (1271) | 21 | upstream |
| CEP290-421 | + | CCAUGGGAGAAUAGUUUGUU (1272) | 20 | upstream |
| CEP290-422 | + | CAUGGGAGAAUAGUUUGUU (1273) | 19 | upstream |
| CEP290-423 | + | CUCCUGUGAAAGGAUCUUAGAU (1274) | 22 | upstream |
| CEP290-424 | + | CCUGUGAAAGGAUCUUAGAU (1275) | 20 | upstream |
| CEP290-426 | + | CUGUGAAAGGAUCUUAGAU (1276) | 19 | upstream |
| CEP290-427 | − | CCCUGGCUUUUGUUCCUUGGA (1277) | 21 | upstream |
| CEP290-428 | − | CCUGGCUUUUGUUCCUUGGA (1278) | 20 | upstream |
| CEP290-429 | − | CUGGCUUUUGUUCCUUGGA (1279) | 19 | upstream |
| CEP290-430 | − | CGUUGUUCUGAGUAGCUUU (1280) | 19 | upstream |
| CEP290-431 | − | CUAUUUAUAGUGGCUGAAUGACUU (1281) | 24 | upstream |
| CEP290-432 | − | CCAUGGUCCCUGGCUUUUGUUCCU (1282) | 24 | upstream |
| CEP290-433 | − | CAUGGUCCCUGGCUUUUGUUCCU (1283) | 23 | upstream |
| CEP290-434 | − | CAUCUUGUGGAUAAUGUAUCA (1284) | 21 | upstream |
| CEP290-435 | − | CUUGUGGAUAAUGUAUCA (1285) | 18 | upstream |
| CEP290-437 | − | CCUAGGCAAGAGACAUCUU (1286) | 19 | upstream |
| CEP290-438 | − | CUAGGCAAGAGACAUCUU (1287) | 18 | upstream |
| CEP290-439 | + | CCAGCAAAAGCUUUUGAGCUAA (1288) | 22 | upstream |
| CEP290-440 | + | CAGCAAAAGCUUUUGAGCUAA (1289) | 21 | upstream |
| CEP290-441 | + | CAAAAGCUUUUGAGCUAA (1290) | 18 | upstream |
| CEP290-442 | + | CUUAUUCUACUCCUGUGA (1291) | 18 | upstream |
| CEP290-443 | − | CUAAGAUCCUUUCACAGGAG (1292) | 20 | upstream |
| CEP290-444 | − | CUUCCUCAUCAGAAAUAGAGGCUU (1293) | 24 | upstream |
| CEP290-445 | − | CCUCAUCAGAAAUAGAGGCUU (1294) | 21 | upstream |
| CEP290-446 | − | CUCAUCAGAAAUAGAGGCUU (1295) | 20 | upstream |
| CEP290-447 | − | CAUCAGAAAUAGAGGCUU (1296) | 18 | upstream |

TABLE 8B-continued

| gRNA Name | DNA Strand | Targeting Domain (SEQ ID NO) | Target Site Length | Position relative to mutation |
|---|---|---|---|---|
| CEP290-448 | − | CUUUCAGGAUUCCUACUAAAUU (1297) | 22 | upstream |
| CEP290-449 | − | CAGGAUUCCUACUAAAUU (1298) | 18 | upstream |
| CEP290-450 | + | CUGUCCUCAGUAAAAGGUA (1299) | 19 | upstream |
| CEP290-451 | + | CUCAGAACAACGUUUUCAUUUA (1300) | 22 | upstream |
| CEP290-452 | + | CAGAACAACGUUUUCAUUUA (1301) | 20 | upstream |
| CEP290-453 | + | CAAGUGGCUGUAAGAUAACUACA (1302) | 23 | upstream |
| CEP290-454 | − | CAUUCAGUAAAUGAAAACGUUGUU (1303) | 24 | upstream |
| CEP290-457 | − | CAGUAAAUGAAAACGUUGUU (1304) | 20 | upstream |
| CEP290-458 | + | CAUGACUCAUAAUUUAGU (1305) | 18 | upstream |
| CEP290-459 | − | CUUAUCUAAGAUCCUUUCAC (1306) | 20 | upstream |
| CEP290-460 | + | CAAAAGCCAGGGACCAUGG (1307) | 19 | upstream |
| CEP290-461 | − | CAGAAAUAGAGGCUUAUGGAUU (1308) | 22 | upstream |
| CEP290-462 | + | CUGGGUACAGGGGUAAGAGAA (1309) | 21 | upstream |
| CEP290-463 | − | CAAUAUAUUAUCUAUUUAUAGUGG (1310) | 24 | upstream |
| CEP290-464 | − | CAUUUUUUAUUGUAGAAUAAAUG (1311) | 23 | upstream |
| CEP290-465 | + | UAAAUCAUGCAAGUGACCUAAG (1312) | 22 | upstream |
| CEP290-466 | + | UCAUGCAAGUGACCUAAG (1313) | 18 | upstream |
| CEP290-467 | − | UUAGGUCACUUGCAUGAUUUAG (1314) | 22 | upstream |
| CEP290-468 | − | UAGGUCACUUGCAUGAUUUAG (1315) | 21 | upstream |
| CEP290-469 | − | UAUUAAGGGCUCUUCCUGGACC (1316) | 22 | upstream |
| CEP290-470 | − | UUAAGGGCUCUUCCUGGACC (1317) | 20 | upstream |
| CEP290-471 | − | UAAGGGCUCUUCCUGGACC (1318) | 19 | upstream |
| CEP290-472 | + | UGCCUAGGACUUUCUAAUGCUGGA (1319) | 24 | upstream |
| CEP290-473 | + | UAGGACUUUCUAAUGCUGGA (1320) | 20 | upstream |
| CEP290-474 | + | UACUCCUGUGAAAGGAUCUUAGAU (1321) | 24 | upstream |
| CEP290-475 | + | UCCUGUGAAAGGAUCUUAGAU (1322) | 21 | upstream |
| CEP290-476 | + | UGUGAAAGGAUCUUAGAU (1323) | 18 | upstream |
| CEP290-477 | − | UCCCUGGCUUUUGUUCCUUGGA (1324) | 22 | upstream |
| CEP290-515 | − | UGGCUUUUGUUCCUUGGA (1325) | 18 | upstream |
| CEP290-516 | − | UAUUUAUAGUGGCUGAAUGACUU (1326) | 23 | upstream |
| CEP290-517 | − | UUUAUAGUGGCUGAAUGACUU (1327) | 21 | upstream |

TABLE 8B-continued

| gRNA Name | DNA Strand | Targeting Domain (SEQ ID NO) | Target Site Length | Position relative to mutation |
|---|---|---|---|---|
| CEP290-518 | − | UUAUAGUGGCUGAAUGACUU (1328) | 20 | upstream |
| CEP290-519 | − | UAUAGUGGCUGAAUGACUU (1329) | 19 | upstream |
| CEP290-520 | − | UGGUCCCUGGCUUUUGUUCCU (1330) | 21 | upstream |
| CEP290-521 | − | UCCCUGGCUUUUGUUCCU (1331) | 18 | upstream |
| CEP290-522 | − | UCUUGUGGAUAAUGUAUCA (1332) | 19 | upstream |
| CEP290-523 | − | UCCUAGGCAAGAGACAUCUU (1333) | 20 | upstream |
| CEP290-524 | + | UUAGAUCUUAUUCUACUCCUGUGA (1334) | 24 | upstream |
| CEP290-525 | + | UAGAUCUUAUUCUACUCCUGUGA (1335) | 23 | upstream |
| CEP290-526 | + | UCUUAUUCUACUCCUGUGA (1336) | 19 | upstream |
| CEP290-527 | − | UUAUCUAAGAUCCUUUCACAGGAG (1337) | 24 | upstream |
| CEP290-528 | − | UAUCUAAGAUCCUUUCACAGGAG (1338) | 23 | upstream |
| CEP290-529 | − | UCUAAGAUCCUUUCACAGGAG (1339) | 21 | upstream |
| CEP290-530 | − | UAAGAUCCUUUCACAGGAG (1340) | 19 | upstream |
| CEP290-531 | − | UUCCUCAUCAGAAAUAGAGGCUU (1341) | 23 | upstream |
| CEP290-532 | − | UCCUCAUCAGAAAUAGAGGCUU (1342) | 22 | upstream |
| CEP290-533 | − | UCAUCAGAAAUAGAGGCUU (1343) | 19 | upstream |
| CEP290-534 | − | UUUCAGGAUUCCUACUAAAUU (1344) | 21 | upstream |
| CEP290-535 | − | UUCAGGAUUCCUACUAAAUU (1345) | 20 | upstream |
| CEP290-536 | − | UCAGGAUUCCUACUAAAUU (1346) | 19 | upstream |
| CEP290-537 | + | UUGUUCUGUCCUCAGUAAAAGGUA (1347) | 24 | upstream |
| CEP290-538 | + | UGUUCUGUCCUCAGUAAAAGGUA (1348) | 23 | upstream |
| CEP290-539 | + | UUCUGUCCUCAGUAAAAGGUA (1349) | 21 | upstream |
| CEP290-540 | + | UCUGUCCUCAGUAAAAGGUA (1350) | 20 | upstream |
| CEP290-541 | + | UGUCCUCAGUAAAAGGUA (1351) | 18 | upstream |
| CEP290-542 | + | UACUCAGAACAACGUUUUCAUUUA (1352) | 24 | upstream |
| CEP290-543 | + | UCAGAACAACGUUUUCAUUUA (1353) | 21 | upstream |
| CEP290-544 | − | UAGAAUAUCAUAAGUUACAAUCU (1354) | 23 | upstream |
| CEP290-545 | − | UAUCAUAAGUUACAAUCU (1355) | 18 | upstream |
| CEP290-546 | + | UCAAGUGGCUGUAAGAUAACUACA (1356) | 24 | upstream |
| CEP290-547 | + | UGGCUGUAAGAUAACUACA (1357) | 19 | upstream |
| CEP290-548 | − | UGUUUAACGUUAUCAUUUUCCCA (1358) | 23 | upstream |
| CEP290-549 | − | UUUAACGUUAUCAUUUUCCCA (1359) | 21 | upstream |

TABLE 8B-continued

| gRNA Name | DNA Strand | Targeting Domain (SEQ ID NO) | Target Site Length | Position relative to mutation |
|---|---|---|---|---|
| CEP290-550 | − | UUAACGUUAUCAUUUUCCCA (1360) | 20 | upstream |
| CEP290-551 | − | UAACGUUAUCAUUUUCCCA (1361) | 19 | upstream |
| CEP290-552 | + | UAAGAGAAAGGGAUGGGCACUUA (1362) | 23 | upstream |
| CEP290-553 | − | UUCAGUAAAUGAAAACGUUGUU (1363) | 22 | upstream |
| CEP290-554 | − | UCAGUAAAUGAAAACGUUGUU (1364) | 21 | upstream |
| CEP290-555 | + | UAAACAUGACUCAUAAUUUAGU (1365) | 22 | upstream |
| CEP290-556 | − | UAUUCUUAUCUAAGAUCCUUUCAC (1366) | 24 | upstream |
| CEP290-557 | − | UUCUUAUCUAAGAUCCUUUCAC (1367) | 22 | upstream |
| CEP290-558 | − | UCUUAUCUAAGAUCCUUUCAC (1368) | 21 | upstream |
| CEP290-559 | − | UUAUCUAAGAUCCUUUCAC (1369) | 19 | upstream |
| CEP290-560 | − | UAUCUAAGAUCCUUUCAC (1370) | 18 | upstream |
| CEP290-561 | − | UCAGAAAUAGAGGCUUAUGGAUU (1371) | 23 | upstream |
| CEP290-562 | + | UUCUGGGUACAGGGGUAAGAGAA (1372) | 23 | upstream |
| CEP290-563 | + | UCUGGGUACAGGGGUAAGAGAA (1373) | 22 | upstream |
| CEP290-564 | + | UGGGUACAGGGGUAAGAGAA (1374) | 20 | upstream |
| CEP290-565 | − | UAUAUUAUCUAUUUAUAGUGG (1375) | 21 | upstream |
| CEP290-566 | − | UAUUAUCUAUUUAUAGUGG (1376) | 19 | upstream |
| CEP290-567 | − | UAAAUUCUCAUCAUUUUUUAUUG (1377) | 23 | upstream |
| CEP290-568 | − | UUCUCAUCAUUUUUUAUUG (1378) | 19 | upstream |
| CEP290-569 | − | UCUCAUCAUUUUUUAUUG (1379) | 18 | upstream |
| CEP290-570 | − | UAGAAUAAAUGUAGAAUUUUAAUG (1380) | 24 | upstream |
| CEP290-571 | − | UAAAUGUAGAAUUUUAAUG (1381) | 19 | upstream |
| CEP290-572 | − | UCAUUUUUUAUUGUAGAAUAAAUG (1382) | 24 | upstream |
| CEP290-573 | − | UUUUUUAUUGUAGAAUAAAUG (1383) | 21 | upstream |
| CEP290-574 | − | UUUUUAUUGUAGAAUAAAUG (1384) | 20 | upstream |
| CEP290-575 | − | UUUUAUUGUAGAAUAAAUG (1385) | 19 | upstream |
| CEP290-576 | − | UUUAUUGUAGAAUAAAUG (1386) | 18 | upstream |
| CEP290-577 | − | AAAAGCUACCGGUUACCUG (1387) | 19 | downstream |
| CEP290-578 | − | AAAGCUACCGGUUACCUG (1388) | 18 | downstream |
| CEP290-579 | + | AGUUUUUAAGGCGGGGAGUCACAU (1389) | 24 | downstream |
| CEP290-580 | − | ACAUCCUCCUUACUGCCAC (1390) | 19 | downstream |

TABLE 8B-continued

| gRNA Name | DNA Strand | Targeting Domain (SEQ ID NO) | Target Site Length | Position relative to mutation |
|---|---|---|---|---|
| CEP290-581 | + | AGUCACAGGGUAGGAUUCAUGUU (1391) | 23 | downstream |
| CEP290-582 | + | ACAGGGUAGGAUUCAUGUU (1392) | 19 | downstream |
| CEP290-583 | − | ACAGAGUUCAAGCUAAUACAU (1393) | 21 | downstream |
| CEP290-584 | − | AGAGUUCAAGCUAAUACAU (1394) | 19 | downstream |
| CEP290-585 | + | AUAAGAUGCAGAACUAGUGUAGAC (1395) | 24 | downstream |
| CEP290-586 | + | AAGAUGCAGAACUAGUGUAGAC (1396) | 22 | downstream |
| CEP290-587 | + | AGAUGCAGAACUAGUGUAGAC (1397) | 21 | downstream |
| CEP290-588 | + | AUGCAGAACUAGUGUAGAC (1398) | 19 | downstream |
| CEP290-589 | − | AGUAUCUCCUGUUUGGCA (1399) | 18 | downstream |
| CEP290-590 | − | ACGAAAAUCAGAUUUCAUGUGUG (1400) | 23 | downstream |
| CEP290-591 | − | AAAAUCAGAUUUCAUGUGUG (1401) | 20 | downstream |
| CEP290-592 | − | AAAUCAGAUUUCAUGUGUG (1402) | 19 | downstream |
| CEP290-593 | − | AAUCAGAUUUCAUGUGUG (1403) | 18 | downstream |
| CEP290-594 | − | ACAAGAAUGAUCAUUCUAAAC (1404) | 21 | downstream |
| CEP290-595 | − | AAGAAUGAUCAUUCUAAAC (1405) | 19 | downstream |
| CEP290-596 | − | AGAAUGAUCAUUCUAAAC (1406) | 18 | downstream |
| CEP290-597 | + | AGGCGGGGAGUCACAUGGGAGUCA (1407) | 24 | downstream |
| CEP290-598 | + | AGCUUUUGACAGUUUUUAAGGCG (1408) | 23 | downstream |
| CEP290-599 | + | AAUGAUCAUUCUUGUGGCAGUAAG (1409) | 24 | downstream |
| CEP290-600 | + | AUGAUCAUUCUUGUGGCAGUAAG (1410) | 23 | downstream |
| CEP290-601 | + | AUCAUUCUUGUGGCAGUAAG (1411) | 20 | downstream |
| CEP290-602 | − | AUCUAGAGCAAGAGAUGAACUAG (1412) | 23 | downstream |
| CEP290-603 | − | AGAGCAAGAGAUGAACUAG (1413) | 19 | downstream |
| CEP290-604 | + | AAUGCCUGAACAAGUUUUGAAAC (1414) | 23 | downstream |
| CEP290-605 | + | AUGCCUGAACAAGUUUUGAAAC (1415) | 22 | downstream |
| CEP290-606 | − | AGAUUGAGGUAGAAUCAAGAA (1416) | 21 | downstream |
| CEP290-607 | − | AUUGAGGUAGAAUCAAGAA (1417) | 19 | downstream |
| CEP290-608 | + | AUGUAAGACUGGAGAUAGAGAC (1418) | 22 | downstream |
| CEP290-609 | + | AAGACUGGAGAUAGAGAC (1419) | 18 | downstream |
| CEP290-610 | + | AGUCACAUGGGAGUCACAGGG (1420) | 21 | downstream |
| CEP290-611 | − | ACAUAUCUGUCUUCCUUAA (1421) | 19 | downstream |

TABLE 8B-continued

| gRNA Name | DNA Strand | Targeting Domain (SEQ ID NO) | Target Site Length | Position relative to mutation |
|---|---|---|---|---|
| CEP290-612 | − | AAAUCAGAUUUCAUGUGUGAAGAA (1422) | 24 | downstream |
| CEP290-613 | − | AAUCAGAUUUCAUGUGUGAAGAA (1423) | 23 | downstream |
| CEP290-614 | − | AUCAGAUUUCAUGUGUGAAGAA (1424) | 22 | downstream |
| CEP290-615 | − | AGAUUUCAUGUGUGAAGAA (1425) | 19 | downstream |
| CEP290-616 | + | AAAUAAAACUAAGACACUGCCAAU (1426) | 24 | downstream |
| CEP290-617 | + | AAUAAAACUAAGACACUGCCAAU (1427) | 23 | downstream |
| CEP290-618 | + | AUAAAACUAAGACACUGCCAAU (1428) | 22 | downstream |
| CEP290-619 | + | AAAACUAAGACACUGCCAAU (610) | 20 | downstream |
| CEP290-620 | + | AAACUAAGACACUGCCAAU (1429) | 19 | downstream |
| CEP290-621 | + | AACUAAGACACUGCCAAU (1430) | 18 | downstream |
| CEP290-622 | − | AACUAUUUAAUUUGUUUCUGUGUG (1431) | 24 | downstream |
| CEP290-623 | − | ACUAUUUAAUUUGUUUCUGUGUG (1432) | 23 | downstream |
| CEP290-624 | − | AUUUAAUUUGUUUCUGUGUG (1433) | 20 | downstream |
| CEP290-625 | − | CUGUCAAAAGCUACCGGUUACCUG (1434) | 24 | downstream |
| CEP290-626 | − | CAAAAGCUACCGGUUACCUG (1435) | 20 | downstream |
| CEP290-627 | − | CUUACAUCCUCCUUACUGCCAC (1436) | 22 | downstream |
| CEP290-628 | − | CAUCCUCCUUACUGCCAC (1437) | 18 | downstream |
| CEP290-629 | + | CACAGGGUAGGAUUCAUGUU (1438) | 20 | downstream |
| CEP290-630 | + | CAGGGUAGGAUUCAUGUU (1439) | 18 | downstream |
| CEP290-631 | − | CACAGAGUUCAAGCUAAUACAU (1440) | 22 | downstream |
| CEP290-632 | − | CAGAGUUCAAGCUAAUACAU (1441) | 20 | downstream |
| CEP290-633 | − | CACGAAAAUCAGAUUUCAUGUGUG (1442) | 24 | downstream |
| CEP290-634 | − | CGAAAAUCAGAUUUCAUGUGUG (1443) | 22 | downstream |
| CEP290-635 | − | CCACAAGAAUGAUCAUUCUAAAC (1444) | 23 | downstream |
| CEP290-636 | − | CACAAGAAUGAUCAUUCUAAAC (1445) | 22 | downstream |
| CEP290-637 | − | CAAGAAUGAUCAUUCUAAAC (1446) | 20 | downstream |
| CEP290-638 | + | CGGGGAGUCACAUGGGAGUCA (1447) | 21 | downstream |
| CEP290-639 | + | CUUUUGACAGUUUUUAAGGCG (1448) | 21 | downstream |
| CEP290-640 | + | CAUUCUUGUGGCAGUAAG (1449) | 18 | downstream |
| CEP290-641 | − | CAUCUAGAGCAAGAGAUGAACUAG (1450) | 24 | downstream |
| CEP290-642 | − | CUAGAGCAAGAGAUGAACUAG (1451) | 21 | downstream |

TABLE 8B-continued

| gRNA Name | DNA Strand | Targeting Domain (SEQ ID NO) | Target Site Length | Position relative to mutation |
| --- | --- | --- | --- | --- |
| CEP290-643 | + | CCUGAACAAGUUUUGAAAC (1452) | 19 | downstream |
| CEP290-644 | + | CUGAACAAGUUUUGAAAC (1453) | 18 | downstream |
| CEP290-645 | − | CUCUCUUCCAGUUGUUUUGCUCA (1454) | 23 | downstream |
| CEP290-646 | − | CUCUUCCAGUUGUUUUGCUCA (1455) | 21 | downstream |
| CEP290-647 | − | CUUCCAGUUGUUUUGCUCA (1456) | 19 | downstream |
| CEP290-648 | + | CACAUGGGAGUCACAGGG (1457) | 18 | downstream |
| CEP290-649 | − | CAUAUCUGUCUUCCUUAA (1458) | 18 | downstream |
| CEP290-650 | − | CAGAUUUCAUGUGUGAAGAA (1459) | 20 | downstream |
| CEP290-651 | − | CUAUUUAAUUUGUUUCUGUGUG (1460) | 22 | downstream |
| CEP290-652 | − | UGUCAAAAGCUACCGGUUACCUG (1461) | 23 | downstream |
| CEP290-653 | − | UCAAAAGCUACCGGUUACCUG (1462) | 21 | downstream |
| CEP290-654 | + | UUUUUAAGGCGGGGAGUCACAU (1463) | 22 | downstream |
| CEP290-655 | + | UUUUAAGGCGGGGAGUCACAU (1464) | 21 | downstream |
| CEP290-656 | + | UUUAAGGCGGGGAGUCACAU (1465) | 20 | downstream |
| CEP290-657 | + | UUAAGGCGGGGAGUCACAU (1466) | 19 | downstream |
| CEP290-658 | + | UAAGGCGGGGAGUCACAU (1467) | 18 | downstream |
| CEP290-659 | − | UCUUACAUCCUCCUUACUGCCAC (1468) | 23 | downstream |
| CEP290-660 | − | UUACAUCCUCCUUACUGCCAC (1469) | 21 | downstream |
| CEP290-661 | − | UACAUCCUCCUUACUGCCAC (1470) | 20 | downstream |
| CEP290-662 | + | UCACAGGGUAGGAUUCAUGUU (1471) | 21 | downstream |
| CEP290-663 | + | UAAGAUGCAGAACUAGUGUAGAC (1472) | 23 | downstream |
| CEP290-664 | + | UGCAGAACUAGUGUAGAC (1473) | 18 | downstream |
| CEP290-665 | − | UGUUGAGUAUCUCCUGUUUGGCA (1474) | 23 | downstream |
| CEP290-666 | − | UUGAGUAUCUCCUGUUUGGCA (1475) | 21 | downstream |
| CEP290-667 | − | UGAGUAUCUCCUGUUUGGCA (1476) | 20 | downstream |
| CEP290-668 | + | UAGCUUUUGACAGUUUUUAAGGCG (1477) | 24 | downstream |
| CEP290-669 | + | UUUUGACAGUUUUUAAGGCG (1478) | 20 | downstream |
| CEP290-670 | + | UUUGACAGUUUUUAAGGCG (1479) | 19 | downstream |
| CEP290-671 | + | UUGACAGUUUUUAAGGCG (1480) | 18 | downstream |
| CEP290-672 | + | UGAUCAUUCUUGUGGCAGUAAG (1481) | 22 | downstream |
| CEP290-673 | + | UCAUUCUUGUGGCAGUAAG (1482) | 19 | downstream |
| CEP290-674 | − | UCUAGAGCAAGAGAUGAACUAG (1483) | 22 | downstream |
| CEP290-675 | − | UAGAGCAAGAGAUGAACUAG (1484) | 20 | downstream |

TABLE 8B-continued

| gRNA Name | DNA Strand | Targeting Domain (SEQ ID NO) | Target Site Length | Position relative to mutation |
|---|---|---|---|---|
| CEP290-676 | + | UAAUGCCUGAACAAGUUUUGAAAC (1485) | 24 | downstream |
| CEP290-677 | + | UGCCUGAACAAGUUUUGAAAC (1486) | 21 | downstream |
| CEP290-678 | − | UGUAGAUUGAGGUAGAAUCAAGAA (1487) | 24 | downstream |
| CEP290-679 | − | UAGAUUGAGGUAGAAUCAAGAA (1488) | 22 | downstream |
| CEP290-680 | − | UUGAGGUAGAAUCAAGAA (1489) | 18 | downstream |
| CEP290-681 | + | UGUAAGACUGGAGAUAGAGAC (1490) | 21 | downstream |
| CEP290-682 | + | UAAGACUGGAGAUAGAGAC (1491) | 19 | downstream |
| CEP290-683 | − | UCUCUCUUCCAGUUGUUUUGCUCA (1492) | 24 | downstream |
| CEP290-684 | − | UCUCUUCCAGUUGUUUUGCUCA (1493) | 22 | downstream |
| CEP290-685 | − | UCUUCCAGUUGUUUUGCUCA (1494) | 20 | downstream |
| CEP290-686 | − | UUCCAGUUGUUUUGCUCA (1495) | 18 | downstream |
| CEP290-687 | + | UCACAUGGGAGUCACAGGG (1496) | 19 | downstream |
| CEP290-688 | − | UGUUUACAUAUCUGUCUUCCUUAA (1497) | 24 | downstream |
| CEP290-689 | − | UUUACAUAUCUGUCUUCCUUAA (1498) | 22 | downstream |
| CEP290-690 | − | UUACAUAUCUGUCUUCCUUAA (1499) | 21 | downstream |
| CEP290-691 | − | UACAUAUCUGUCUUCCUUAA (1500) | 20 | downstream |
| CEP290-692 | − | UCAGAUUUCAUGUGUGAAGAA (1501) | 21 | downstream |
| CEP290-693 | + | UAAAACUAAGACACUGCCAAU (1502) | 21 | downstream |
| CEP290-694 | − | UAUUUAAUUUGUUUCUGUGUG (1503) | 21 | downstream |
| CEP290-695 | − | UUUAAUUUGUUUCUGUGUG (1504) | 19 | downstream |
| CEP290-696 | − | UUAAUUUGUUUCUGUGUG (1505) | 18 | downstream |

Table 8C provides targeting domains for break-induced deletion of genomic sequence including the mutation at the LCA10 target position in the CEP290 gene selected according to the third tier parameters. The targeting domains are within 1000 bp upstream of an Alu repeat, within 40 bp upstream of mutation, or 1000 bp downstream of the mutation, start with G and PAM is NNGRRT. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 8C

| gRNA Name | DNA Strand | Targeting Domain (SEQ ID NO) | Target Site Length | Position relative to mutation |
|---|---|---|---|---|
| CEP290-697 | − | GUAGAAUAAAUUUAUUUAAUG (1506) | 21 | upstream |
| CEP290-495 | − | GAAUAAAUUUAUUUAAUG (1507) | 18 | upstream |
| CEP290-698 | − | GAGAAAAGGAGCAUGAAACAGG (1508) | 23 | upstream |

TABLE 8C-continued

| gRNA Name | DNA Strand | Targeting Domain (SEQ ID NO) | Target Site Length | Position relative to mutation |
|---|---|---|---|---|
| CEP290-699 | − | GAAAAAGGAGCAUGAAACAGG (1509) | 21 | upstream |
| CEP290-700 | − | GUAGAAUAAAAAAUAAAAAAAC (1510) | 22 | upstream |
| CEP290-701 | − | GAAUAAAAAAUAAAAAAAC (1511) | 19 | upstream |
| CEP290-702 | − | GAAUAAAAAAUAAAAAAACUAGAG (1512) | 24 | upstream |
| CEP290-508 | − | GAAAUAGAUGUAGAUUGAGG (1513) | 20 | downstream |
| CEP290-703 | − | GAUAAUAAGGAAAUACAAAAA (1514) | 21 | downstream |
| CEP290-704 | − | GUGUUGCCCAGGCUGGAGUGCAG (1515) | 23 | downstream |
| CEP290-705 | − | GUUGCCCAGGCUGGAGUGCAG (1516) | 21 | downstream |
| CEP290-706 | − | GCCCAGGCUGGAGUGCAG (1517) | 18 | downstream |
| CEP290-707 | − | GUUGUUUUUUUUUUUGAAA (1518) | 19 | downstream |
| CEP290-708 | − | GAGUCUCACUGUGUUGCCCAGGC (1519) | 23 | downstream |
| CEP290-709 | − | GUCUCACUGUGUUGCCCAGGC (1520) | 21 | downstream |

Table 8D provides targeting domains for break-induced deletion of genomic sequence including the mutation at the LCA10 target position in the CEP290 gene selected according to the fourth tier parameters. The targeting domains are within 1000 bp upstream of an Alu repeat, within 40 bp upstream of mutation, or 1000 bp downstream of the mutation and PAM is NNGRRT. It is contemplated herein that the targeting domain hybridizes to the target domain through complementary base pairing. Any of the targeting domains in the table can be used with a S. aureus Cas9 molecule that generates a double stranded break (Cas9 nuclease) or a single-stranded break (Cas9 nickase).

TABLE 8D

| gRNA Name | DNA Strand | Targeting Domain (SEQ ID NO) | Target Site Length | Position relative to mutation |
|---|---|---|---|---|
| CEP290-710 | − | AAUGUAGAAUAAAUUUAUUUAAUG (1521) | 24 | upstream |
| CEP290-711 | − | AUGUAGAAUAAAUUUAUUUAAUG (1522) | 23 | upstream |
| CEP290-712 | − | AGAAUAAAUUUAUUUAAUG (1523) | 19 | upstream |
| CEP290-713 | + | AUUUAUUCUACAAUAAAAAAUGAU (1524) | 24 | upstream |
| CEP290-714 | + | AUUCUACAAUAAAAAAUGAU (1525) | 20 | upstream |
| CEP290-715 | − | AGAGAAAAAGGAGCAUGAAACAGG (1526) | 24 | upstream |
| CEP290-716 | − | AGAAAAAGGAGCAUGAAACAGG (1527) | 22 | upstream |
| CEP290-717 | − | AAAAAGGAGCAUGAAACAGG (1528) | 20 | upstream |
| CEP290-718 | − | AAAAGGAGCAUGAAACAGG (1529) | 19 | upstream |
| CEP290-719 | − | AAAGGAGCAUGAAACAGG (1530) | 18 | upstream |

TABLE 8D-continued

| gRNA Name | DNA Strand | Targeting Domain (SEQ ID NO) | Target Site Length | Position relative to mutation |
|---|---|---|---|---|
| CEP290-720 | + | ACAAUAAAAAUGAUGAGAAUUUA (1531) | 24 | upstream |
| CEP290-721 | + | AAUAAAAAUGAUGAGAAUUUA (1532) | 22 | upstream |
| CEP290-722 | + | AUAAAAAUGAUGAGAAUUUA (1533) | 21 | upstream |
| CEP290-723 | + | AAAAAUGAUGAGAAUUUA (1534) | 19 | upstream |
| CEP290-724 | + | AAAAUGAUGAGAAUUUA (1535) | 18 | upstream |
| CEP290-725 | − | AUGUAGAAUAAAAAUAAAAAAC (1536) | 24 | upstream |
| CEP290-726 | − | AGAAUAAAAAUAAAAAAC (1537) | 20 | upstream |
| CEP290-727 | − | AAUAAAAAUAAAAAAC (1538) | 18 | upstream |
| CEP290-728 | − | AAUAAAAAUAAAAAACUAGAG (1539) | 23 | upstream |
| CEP290-729 | − | AUAAAAAUAAAAAACUAGAG (1540) | 22 | upstream |
| CEP290-730 | − | AAAAAUAAAAAACUAGAG (1541) | 20 | upstream |
| CEP290-731 | − | AAAAUAAAAAACUAGAG (1542) | 19 | upstream |
| CEP290-732 | − | AAAUAAAAAACUAGAG (1543) | 18 | upstream |
| CEP290-733 | + | CAAUAAAAAUGAUGAGAAUUUA (1544) | 23 | upstream |
| CEP290-734 | − | UGUAGAAUAAAUUUAUUUAAUG (1545) | 22 | upstream |
| CEP290-735 | − | UAGAAUAAAUUUAUUUAAUG (1546) | 20 | upstream |
| CEP290-736 | + | UUUAUUCUACAAUAAAAAUGAU (1547) | 23 | upstream |
| CEP290-737 | + | UUAUUCUACAAUAAAAAUGAU (1548) | 22 | upstream |
| CEP290-738 | + | UAUUCUACAAUAAAAAUGAU (1549) | 21 | upstream |
| CEP290-739 | + | UUCUACAAUAAAAAUGAU (1550) | 19 | upstream |
| CEP290-740 | + | UCUACAAUAAAAAUGAU (1551) | 18 | upstream |
| CEP290-741 | + | UAAAAAUGAUGAGAAUUUA (1552) | 20 | upstream |
| CEP290-742 | − | UGUAGAAUAAAAAUAAAAAAC (1553) | 23 | upstream |
| CEP290-743 | − | UAGAAUAAAAAUAAAAAAC (1554) | 21 | upstream |
| CEP290-744 | − | UAAAAAUAAAAAACUAGAG (1555) | 21 | upstream |
| CEP290-745 | − | AAAAGAAAUAGAUGUAGAUUGAGG (1556) | 24 | downstream |
| CEP290-746 | − | AAAGAAAUAGAUGUAGAUUGAGG (1557) | 23 | downstream |
| CEP290-747 | − | AAGAAAUAGAUGUAGAUUGAGG (1558) | 22 | downstream |
| CEP290-748 | − | AGAAAUAGAUGUAGAUUGAGG (1559) | 21 | downstream |
| CEP290-749 | − | AAAUAGAUGUAGAUUGAGG (1560) | 19 | downstream |
| CEP290-750 | − | AAUAGAUGUAGAUUGAGG (1561) | 18 | downstream |

TABLE 8D-continued

| gRNA Name | DNA Strand | Targeting Domain (SEQ ID NO) | Target Site Length | Position relative to mutation |
|---|---|---|---|---|
| CEP290-751 | - | AUAAUAAGGAAAUACAAAAACUGG (1562) | 24 | downstream |
| CEP290-752 | - | AAUAAGGAAAUACAAAAACUGG (1563) | 22 | downstream |
| CEP290-753 | - | AUAAGGAAAUACAAAAACUGG (1564) | 21 | downstream |
| CEP290-754 | - | AAGGAAAUACAAAAACUGG (1565) | 19 | downstream |
| CEP290-755 | - | AGGAAAUACAAAAACUGG (1566) | 18 | downstream |
| CEP290-756 | - | AUAGAUAAUAAGGAAAUACAAAAA (1567) | 24 | downstream |
| CEP290-757 | - | AGAUAAUAAGGAAAUACAAAAA (1568) | 22 | downstream |
| CEP290-758 | - | AUAAUAAGGAAAUACAAAAA (1569) | 20 | downstream |
| CEP290-759 | - | AAUAAGGAAAUACAAAAA (1570) | 18 | downstream |
| CEP290-760 | + | AAAAAAAAAAACAACAAAAA (1571) | 20 | downstream |
| CEP290-761 | + | AAAAAAAAACAACAAAAA (1572) | 19 | downstream |
| CEP290-762 | + | AAAAAAAACAACAAAAA (1573) | 18 | downstream |
| CEP290-763 | - | AGAGUCUCACUGUGUUGCCCAGGC (1574) | 24 | downstream |
| CEP290-764 | - | AGUCUCACUGUGUUGCCCAGGC (1575) | 22 | downstream |
| CEP290-765 | + | CAAAAAAAAAAACAACAAAAA (1576) | 21 | downstream |
| CEP290-766 | - | CUCACUGUGUUGCCCAGGC (1577) | 19 | downstream |
| CEP290-767 | - | UAAUAAGGAAAUACAAAAACUGG (1578) | 23 | downstream |
| CEP290-768 | - | UAAGGAAAUACAAAAACUGG (1579) | 20 | downstream |
| CEP290-769 | - | UAGAUAAUAAGGAAAUACAAAAA (1580) | 23 | downstream |
| CEP290-770 | - | UAAUAAGGAAAUACAAAAA (1581) | 19 | downstream |
| CEP290-771 | - | UGUGUUGCCCAGGCUGGAGUGCAG (1582) | 24 | downstream |
| CEP290-772 | - | UGUUGCCCAGGCUGGAGUGCAG (1583) | 22 | downstream |
| CEP290-773 | - | UUGCCCAGGCUGGAGUGCAG (1584) | 20 | downstream |
| CEP290-774 | - | UGCCCAGGCUGGAGUGCAG (1585) | 19 | downstream |
| CEP290-775 | + | UUUCAAAAAAAAAAACAACAAAAA (1586) | 24 | downstream |
| CEP290-776 | + | UUCAAAAAAAAAAACAACAAAAA (1587) | 23 | downstream |
| CEP290-777 | + | UCAAAAAAAAAAACAACAAAAA (1588) | 22 | downstream |
| CEP290-778 | - | UUUUUGUUGUUUUUUUUUUUGAAA (1589) | 24 | downstream |
| CEP290-779 | - | UUUUGUUGUUUUUUUUUUUGAAA (1590) | 23 | downstream |
| CEP290-780 | - | UUUGUUGUUUUUUUUUUUGAAA (1591) | 22 | downstream |

TABLE 8D-continued

| gRNA Name | DNA Strand | Targeting Domain (SEQ ID NO) | Target Site Length | Position relative to mutation |
|---|---|---|---|---|
| CEP290-781 | − | UUGUUGUUUUUUUUUUGAAA (1592) | 21 | downstream |
| CEP290-782 | − | UGUUGUUUUUUUUUUGAAA (1593) | 20 | downstream |
| CEP290-783 | − | UUGUUUUUUUUUUGAAA (1594) | 18 | downstream |
| CEP290-784 | − | UCUCACUGUGUUGCCCAGGC (1595) | 20 | downstream |
| CEP290-785 | − | UCACUGUGUUGCCCAGGC (1596) | 18 | downstream |

Table 8E provides targeting domains for break-induced deletion of genomic sequence including the mutation at the LCA10 target position in the CEP290 gene selected according to the fifth tier parameters. The targeting domains are within 1000 bp upstream of an Alu repeat, within 40 bp upstream of mutation, or 1000 bp downstream of the mutation and PAM is NNGRRV. It is contemplated herein that the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 8E

| gRNA Name | DNA Strand | Targeting Domain (SEQ ID NO) | Target Site Length | |
|---|---|---|---|---|
| CEP290-786 | + | ACUGUUGGCUACAUCCAUUCC (1597) | 21 | upstream |
| CEP290-787 | + | AAUUUACAGAGUGCAUCCAUGGUC (1598) | 24 | upstream |
| CEP290-788 | + | AUUUACAGAGUGCAUCCAUGGUC (1599) | 23 | upstream |
| CEP290-789 | + | ACAGAGUGCAUCCAUGGUC (1600) | 19 | upstream |
| CEP290-790 | − | AGCAUUAGAAAGUCCUAGGC (1601) | 20 | upstream |
| CEP290-791 | − | AUGGUCCCUGGCUUUUGUUCC (1602) | 21 | upstream |
| CEP290-792 | − | AUAGAGACACAUUCAGUAA (1603) | 19 | upstream |
| CEP290-793 | − | AGCUCAAAAGCUUUUGCUGGCUCA (1604) | 24 | upstream |
| CEP290-794 | − | AAAAGCUUUUGCUGGCUCA (1605) | 19 | upstream |
| CEP290-795 | − | AAAGCUUUUGCUGGCUCA (1606) | 18 | upstream |
| CEP290-796 | + | AAUCCAUAAGCCUCUAUUUCUGAU (1607) | 24 | upstream |
| CEP290-797 | + | AUCCAUAAGCCUCUAUUUCUGAU (1608) | 23 | upstream |
| CEP290-798 | + | AUAAGCCUCUAUUUCUGAU (1609) | 19 | upstream |
| CEP290-799 | + | AGCUAAAUCAUGCAAGUGACCUA (1610) | 23 | upstream |
| CEP290-800 | + | AAAUCAUGCAAGUGACCUA (1611) | 19 | upstream |
| CEP290-801 | + | AAUCAUGCAAGUGACCUA (1612) | 18 | upstream |
| CEP290-802 | − | AAACCUCUUUUAACCAGACAUCU (1613) | 23 | upstream |
| CEP290-803 | − | AACCUCUUUUAACCAGACAUCU (1614) | 22 | upstream |
| CEP290-804 | − | ACCUCUUUUAACCAGACAUCU (1615) | 21 | upstream |
| CEP290-805 | + | AGUUUGUUCUGGGUACAGGGGUAA (1616) | 24 | upstream |

TABLE 8E-continued

| gRNA Name | DNA Strand | Targeting Domain (SEQ ID NO) | Target Site Length | |
|---|---|---|---|---|
| CEP290-806 | + | AUGACUCAUAAUUUAGUAGGAAUC (1617) | 24 | upstream |
| CEP290-807 | + | ACUCAUAAUUUAGUAGGAAUC (1618) | 21 | upstream |
| CEP290-808 | − | AAUGGAUGUAGCCAACAGUAG (1619) | 21 | upstream |
| CEP290-809 | − | AUGGAUGUAGCCAACAGUAG (1620) | 20 | upstream |
| CEP290-810 | + | AUCACCUCUCUUUGGCAAAAGCAG (1621) | 24 | upstream |
| CEP290-811 | + | ACCUCUCUUUGGCAAAAGCAG (1622) | 21 | upstream |
| CEP290-812 | − | AGGUAGAAUAUUGUAAUCAAAGG (1623) | 23 | upstream |
| CEP290-813 | − | AGAAUAUUGUAAUCAAAGG (1624) | 19 | upstream |
| CEP290-814 | + | AAGGAACAAAAGCCAGGGACC (1625) | 21 | upstream |
| CEP290-815 | + | AGGAACAAAAGCCAGGGACC (1626) | 20 | upstream |
| CEP290-816 | + | ACAUCCAUUCCAAGGAACAAAAGC (1627) | 24 | upstream |
| CEP290-817 | + | AUCCAUUCCAAGGAACAAAAGC (1628) | 22 | upstream |
| CEP290-818 | + | AUUCCAAGGAACAAAAGC (1629) | 18 | upstream |
| CEP290-819 | + | AGAAUUAGAUCUUAUUCUACUCCU (1630) | 24 | upstream |
| CEP290-820 | + | AAUUAGAUCUUAUUCUACUCCU (1631) | 22 | upstream |
| CEP290-821 | + | AUUAGAUCUUAUUCUACUCCU (1632) | 21 | upstream |
| CEP290-822 | + | AGAUCUUAUUCUACUCCU (1633) | 18 | upstream |
| CEP290-823 | − | AUUUGUUCAUCUUCCUCAU (1634) | 19 | upstream |
| CEP290-824 | − | AGAGGUGAUUAUGUUACUUUUUA (1635) | 23 | upstream |
| CEP290-825 | − | AGGUGAUUAUGUUACUUUUUA (1636) | 21 | upstream |
| CEP290-826 | − | AACCUCUUUUAACCAGACAUCUAA (1637) | 24 | upstream |
| CEP290-827 | − | ACCUCUUUUAACCAGACAUCUAA (1638) | 23 | upstream |
| CEP290-828 | + | AUAAACAUGACUCAUAAUUUAG (1639) | 22 | upstream |
| CEP290-829 | + | AAACAUGACUCAUAAUUUAG (1640) | 20 | upstream |
| CEP290-830 | + | AACAUGACUCAUAAUUUAG (1641) | 19 | upstream |
| CEP290-831 | + | ACAUGACUCAUAAUUUAG (1642) | 18 | upstream |
| CEP290-832 | − | ACAGGUAGAAUAUUGUAAUCAAAG (1643) | 24 | upstream |
| CEP290-833 | − | AGGUAGAAUAUUGUAAUCAAAG (1644) | 22 | upstream |
| CEP290-834 | − | AGAAUAUUGUAAUCAAAG (1645) | 18 | upstream |
| CEP290-835 | + | AUAGUUUGUUCUGGGUACAGGGGU (1646) | 24 | upstream |
| CEP290-836 | + | AGUUUGUUCUGGGUACAGGGGU (1647) | 22 | upstream |

TABLE 8E-continued

| gRNA Name | DNA Strand | Targeting Domain (SEQ ID NO) | Target Site Length | |
|---|---|---|---|---|
| CEP290-837 | − | AGACAUCUAAGAGAAAAAGGAGC (1648) | 23 | upstream |
| CEP290-838 | − | ACAUCUAAGAGAAAAAGGAGC (1649) | 21 | upstream |
| CEP290-839 | − | AUCUAAGAGAAAAAGGAGC (1650) | 19 | upstream |
| CEP290-840 | + | AGAGGAUAGGACAGAGGACA (1651) | 20 | upstream |
| CEP290-841 | + | AGGAUAGGACAGAGGACA (1652) | 18 | upstream |
| CEP290-842 | + | AGGAAAGAUGAAAAAUACUCUU (1653) | 22 | upstream |
| CEP290-843 | + | AAAGAUGAAAAAUACUCUU (1654) | 19 | upstream |
| CEP290-844 | + | AAGAUGAAAAAUACUCUU (1655) | 18 | upstream |
| CEP290-845 | + | AGGAAAGAUGAAAAAUACUCUUU (1656) | 23 | upstream |
| CEP290-846 | + | AAAGAUGAAAAAUACUCUUU (1657) | 20 | upstream |
| CEP290-847 | + | AAGAUGAAAAAUACUCUUU (1658) | 19 | upstream |
| CEP290-848 | + | AGAUGAAAAAUACUCUUU (1659) | 18 | upstream |
| CEP290-849 | + | AGGAAAGAUGAAAAAUACUCU (1660) | 21 | upstream |
| CEP290-850 | + | AAAGAUGAAAAAUACUCU (1661) | 18 | upstream |
| CEP290-851 | + | AUAGGACAGAGGACAUGGAGAA (1662) | 22 | upstream |
| CEP290-852 | + | AGGACAGAGGACAUGGAGAA (1663) | 20 | upstream |
| CEP290-853 | + | AGGAUAGGACAGAGGACAUGGAGA (1664) | 24 | upstream |
| CEP290-854 | + | AUAGGACAGAGGACAUGGAGA (1665) | 21 | upstream |
| CEP290-855 | + | AGGACAGAGGACAUGGAGA (1666) | 19 | upstream |
| CEP290-856 | + | AAGGAACAAAAGCCAGGGACCAU (1667) | 23 | upstream |
| CEP290-857 | + | AGGAACAAAAGCCAGGGACCAU (1668) | 22 | upstream |
| CEP290-858 | + | AACAAAAGCCAGGGACCAU (1669) | 19 | upstream |
| CEP290-859 | + | ACAAAAGCCAGGGACCAU (1670) | 18 | upstream |
| CEP290-860 | + | ACAUUUAUUCUACAAUAAAAAAUG (1671) | 24 | upstream |
| CEP290-861 | + | AUUUAUUCUACAAUAAAAAAUG (1672) | 22 | upstream |
| CEP290-862 | + | AUUCUACAAUAAAAAAUG (1673) | 18 | upstream |
| CEP290-863 | + | AUUGUGUGUGUGUGUGUGUUAU (1674) | 24 | upstream |
| CEP290-864 | + | CUACUGUUGGCUACAUCCAUUCC (1675) | 23 | upstream |
| CEP290-865 | + | CUGUUGGCUACAUCCAUUCC (1676) | 20 | upstream |
| CEP290-866 | + | CAGAGUGCAUCCAUGGUC (1677) | 18 | upstream |
| CEP290-867 | − | CUCCAGCAUUAGAAAGUCCUAGGC (1678) | 24 | upstream |
| CEP290-868 | − | CCAGCAUUAGAAAGUCCUAGGC (1679) | 22 | upstream |

TABLE 8E-continued

| gRNA Name | DNA Strand | Targeting Domain (SEQ ID NO) | Target Site Length | |
|---|---|---|---|---|
| CEP290-869 | − | CAGCAUUAGAAAGUCCUAGGC (1680) | 21 | upstream |
| CEP290-870 | − | CAUUAGAAAGUCCUAGGC (1681) | 18 | upstream |
| CEP290-871 | − | CCCAUGGUCCCUGGCUUUUGUUCC (1682) | 24 | upstream |
| CEP290-872 | − | CCAUGGUCCCUGGCUUUUGUUCC (1683) | 23 | upstream |
| CEP290-873 | − | CAUGGUCCCUGGCUUUUGUUCC (1684) | 22 | upstream |
| CEP290-874 | − | CUCAUAGAGACACAUUCAGUAA (1685) | 22 | upstream |
| CEP290-875 | − | CAUAGAGACACAUUCAGUAA (1686) | 20 | upstream |
| CEP290-876 | − | CUCAAAAGCUUUUGCUGGCUCA (1687) | 22 | upstream |
| CEP290-877 | − | CAAAAGCUUUUGCUGGCUCA (1688) | 20 | upstream |
| CEP290-878 | + | CCAUAAGCCUCUAUUUCUGAU (1689) | 21 | upstream |
| CEP290-879 | + | CAUAAGCCUCUAUUUCUGAU (1690) | 20 | upstream |
| CEP290-880 | + | CAGCUAAAUCAUGCAAGUGACCUA (1691) | 24 | upstream |
| CEP290-881 | + | CUAAAUCAUGCAAGUGACCUA (1692) | 21 | upstream |
| CEP290-882 | − | CAAACCUCUUUUAACCAGACAUCU (1693) | 24 | upstream |
| CEP290-883 | − | CCUCUUUUAACCAGACAUCU (1694) | 20 | upstream |
| CEP290-884 | − | CUCUUUUAACCAGACAUCU (1695) | 19 | upstream |
| CEP290-885 | + | CUCAUAAUUUAGUAGGAAUC (1696) | 20 | upstream |
| CEP290-886 | + | CAUAAUUUAGUAGGAAUC (1697) | 18 | upstream |
| CEP290-887 | + | CACCUCUCUUUGGCAAAAGCAG (1698) | 22 | upstream |
| CEP290-888 | + | CCUCUCUUUGGCAAAAGCAG (1699) | 20 | upstream |
| CEP290-889 | + | CUCUCUUUGGCAAAAGCAG (1700) | 19 | upstream |
| CEP290-890 | − | CAGGUAGAAUAUUGUAAUCAAAGG (1701) | 24 | upstream |
| CEP290-891 | + | CCAAGGAACAAAAGCCAGGGACC (1702) | 23 | upstream |
| CEP290-892 | + | CAAGGAACAAAAGCCAGGGACC (1703) | 22 | upstream |
| CEP290-893 | + | CAUCCAUUCCAAGGAACAAAAGC (1704) | 23 | upstream |
| CEP290-894 | + | CCAUUCCAAGGAACAAAAGC (1705) | 20 | upstream |
| CEP290-895 | + | CAUUCCAAGGAACAAAAGC (1706) | 19 | upstream |
| CEP290-896 | + | CUCUUGCCUAGGACUUUCUAAUGC (1707) | 24 | upstream |
| CEP290-897 | + | CUUGCCUAGGACUUUCUAAUGC (1708) | 22 | upstream |
| CEP290-898 | + | CCUAGGACUUUCUAAUGC (1709) | 18 | upstream |
| CEP290-899 | − | CCUGAUUUGUUCAUCUUCCUCAU (1710) | 23 | upstream |

TABLE 8E-continued

| gRNA Name | DNA Strand | Targeting Domain (SEQ ID NO) | Target Site Length | |
|---|---|---|---|---|
| CEP290-900 | − | CUGAUUUGUUCAUCUUCCUCAU (1711) | 22 | upstream |
| CEP290-901 | − | CCUCUUUUAACCAGACAUCUAA (1712) | 22 | upstream |
| CEP290-902 | − | CUCUUUUAACCAGACAUCUAA (1713) | 21 | upstream |
| CEP290-903 | − | CUUUUAACCAGACAUCUAA (1714) | 19 | upstream |
| CEP290-904 | − | CCUCUGUCCUAUCCUCUCCAGCAU (1715) | 24 | upstream |
| CEP290-905 | − | CUCUGUCCUAUCCUCUCCAGCAU (1716) | 23 | upstream |
| CEP290-906 | − | CUGUCCUAUCCUCUCCAGCAU (1717) | 21 | upstream |
| CEP290-907 | − | CAGGUAGAAUAUUGUAAUCAAAG (1718) | 23 | upstream |
| CEP290-908 | + | CUGGGUACAGGGGUAAGAGA (1719) | 20 | upstream |
| CEP290-909 | − | CUUUCUGCUGCUUUUGCCA (1720) | 19 | upstream |
| CEP290-910 | − | CAGACAUCUAAGAGAAAAAGGAGC (1721) | 24 | upstream |
| CEP290-911 | − | CAUCUAAGAGAAAAAGGAGC (1722) | 20 | upstream |
| CEP290-912 | + | CUGGAGAGGAUAGGACAGAGGACA (1723) | 24 | upstream |
| CEP290-913 | + | CAAGGAACAAAAGCCAGGGACCAU (1724) | 24 | upstream |
| CEP290-914 | + | CAUUUAUUCUACAAUAAAAAAUG (1725) | 23 | upstream |
| CEP290-915 | + | GCUACUGUUGGCUACAUCCAUUCC (1726) | 24 | upstream |
| CEP290-916 | + | GUUGGCUACAUCCAUUCC (1727) | 18 | upstream |
| CEP290-917 | − | GCAUUAGAAAGUCCUAGGC (1728) | 19 | upstream |
| CEP290-918 | − | GGUCCCUGGCUUUUGUUCC (1729) | 19 | upstream |
| CEP290-919 | − | GUCCCUGGCUUUUGUUCC (1730) | 18 | upstream |
| CEP290-920 | − | GGCUCAUAGAGACACAUUCAGUAA (1731) | 24 | upstream |
| CEP290-921 | − | GCUCAUAGAGACACAUUCAGUAA (1732) | 23 | upstream |
| CEP290-922 | − | GCUCAAAAGCUUUUGCUGGCUCA (1733) | 23 | upstream |
| CEP290-923 | + | GCUAAAUCAUGCAAGUGACCUA (1734) | 22 | upstream |
| CEP290-924 | + | GUUUGUUCUGGGUACAGGGGUAA (1735) | 23 | upstream |
| CEP290-925 | + | GUUCUGGGUACAGGGGUAA (1736) | 19 | upstream |
| CEP290-926 | + | GACUCAUAAUUUAGUAGGAAUC (1737) | 22 | upstream |
| CEP290-927 | − | GGAAUGGAUGUAGCCAACAGUAG (1738) | 23 | upstream |
| CEP290-928 | − | GAAUGGAUGUAGCCAACAGUAG (1739) | 22 | upstream |
| CEP290-929 | − | GGAUGUAGCCAACAGUAG (1740) | 18 | upstream |

TABLE 8E-continued

| gRNA Name | DNA Strand | Targeting Domain (SEQ ID NO) | Target Site Length | |
|---|---|---|---|---|
| CEP290-930 | - | GGUAGAAUAUUGUAAUCAAAGG (1741) | 22 | upstream |
| CEP290-931 | - | GUAGAAUAUUGUAAUCAAAGG (1742) | 21 | upstream |
| CEP290-932 | - | GAAUAUUGUAAUCAAAGG (1743) | 18 | upstream |
| CEP290-933 | + | GGAACAAAGCCAGGGACC (1744) | 19 | upstream |
| CEP290-934 | + | GAACAAAGCCAGGGACC (1745) | 18 | upstream |
| CEP290-935 | + | GAAUUAGAUCUUAUUCUACUCCU (1746) | 23 | upstream |
| CEP290-936 | + | GCCUAGGACUUUCUAAUGC (1747) | 19 | upstream |
| CEP290-937 | - | GAUUUGUUCAUCUUCCUCAU (1748) | 20 | upstream |
| CEP290-938 | - | GAGAGGUGAUUAUGUUACUUUUUA (1749) | 24 | upstream |
| CEP290-939 | - | GAGGUGAUUAUGUUACUUUUUA (1750) | 22 | upstream |
| CEP290-940 | - | GGUGAUUAUGUUACUUUUUA (1751) | 20 | upstream |
| CEP290-941 | - | GUGAUUAUGUUACUUUUUA (1752) | 19 | upstream |
| CEP290-942 | - | GUCCUAUCCUCUCCAGCAU (1753) | 19 | upstream |
| CEP290-943 | + | GAUAAACAUGACUCAUAAUUUAG (1754) | 23 | upstream |
| CEP290-944 | - | GGUAGAAUAUUGUAAUCAAAG (1755) | 21 | upstream |
| CEP290-945 | - | GUAGAAUAUUGUAAUCAAAG (1756) | 20 | upstream |
| CEP290-946 | + | GUUCUGGGUACAGGGGUAAGAGA (1757) | 23 | upstream |
| CEP290-947 | + | GGGUACAGGGGUAAGAGA (1758) | 18 | upstream |
| CEP290-948 | + | GUUUGUUCUGGGUACAGGGGU (1759) | 21 | upstream |
| CEP290-949 | - | GUUUGCUUUCUGCUGCUUUUGCCA (1760) | 24 | upstream |
| CEP290-950 | - | GCUUUCUGCUGCUUUUGCCA (1761) | 20 | upstream |
| CEP290-951 | - | GACAUCUAAGAGAAAAAGGAGC (1762) | 22 | upstream |
| CEP290-952 | + | GGAGAGGAUAGGACAGAGGACA (1763) | 22 | upstream |
| CEP290-953 | + | GAGAGGAUAGGACAGAGGACA (1764) | 21 | upstream |
| CEP290-954 | + | GAGGAUAGGACAGAGGACA (1765) | 19 | upstream |
| CEP290-955 | + | GGAAAGAUGAAAAAUACUCUU (1766) | 21 | upstream |
| CEP290-956 | + | GAAAGAUGAAAAAUACUCUU (462) | 20 | upstream |
| CEP290-957 | + | GGAAAGAUGAAAAAUACUCUUU (1767) | 22 | upstream |
| CEP290-958 | + | GAAAGAUGAAAAAUACUCUUU (1768) | 21 | upstream |
| CEP290-959 | + | GGAAAGAUGAAAAAUACUCU (1769) | 20 | upstream |
| CEP290-960 | + | GAAAGAUGAAAAAUACUCU (1770) | 19 | upstream |
| CEP290-961 | + | GGAUAGGACAGAGGACAUGGAGAA (1771) | 24 | upstream |

TABLE 8E-continued

| gRNA Name | DNA Strand | Targeting Domain (SEQ ID NO) | Target Site Length | |
|---|---|---|---|---|
| CEP290-962 | + | GAUAGGACAGAGGACAUGGAGAA (1772) | 23 | upstream |
| CEP290-963 | + | GGACAGAGGACAUGGAGAA (1773) | 19 | upstream |
| CEP290-964 | + | GACAGAGGACAUGGAGAA (1774) | 18 | upstream |
| CEP290-965 | + | GGAUAGGACAGAGGACAUGGAGA (1775) | 23 | upstream |
| CEP290-966 | + | GAUAGGACAGAGGACAUGGAGA (1776) | 22 | upstream |
| CEP290-967 | + | GGACAGAGGACAUGGAGA (1777) | 18 | upstream |
| CEP290-968 | + | GGAACAAAAGCCAGGGACCAU (1778) | 21 | upstream |
| CEP290-969 | + | GAACAAAAGCCAGGGACCAU (465) | 20 | upstream |
| CEP290-970 | + | GUGUGUGUGUGUGUGUUAU (1779) | 21 | upstream |
| CEP290-971 | + | GUGUGUGUGUGUGUUAU (1780) | 19 | upstream |
| CEP290-972 | + | GUGUGUGUGUGUGUGUUAUG (1781) | 22 | upstream |
| CEP290-973 | + | GUGUGUGUGUGUGUUAUG (1782) | 20 | upstream |
| CEP290-974 | + | GUGUGUGUGUGUUAUG (1783) | 18 | upstream |
| CEP290-975 | + | UACUGUUGGCUACAUCCAUUCC (1784) | 22 | upstream |
| CEP290-976 | + | UGUUGGCUACAUCCAUUCC (1785) | 19 | upstream |
| CEP290-977 | + | UUUACAGAGUGCAUCCAUGGUC (1786) | 22 | upstream |
| CEP290-978 | + | UUACAGAGUGCAUCCAUGGUC (1787) | 21 | upstream |
| CEP290-979 | + | UACAGAGUGCAUCCAUGGUC (1788) | 20 | upstream |
| CEP290-980 | - | UCCAGCAUUAGAAAGUCCUAGGC (1789) | 23 | upstream |
| CEP290-981 | - | UGGUCCCUGGCUUUUGUUCC (1790) | 20 | upstream |
| CEP290-982 | - | UCAUAGAGACACAUUCAGUAA (1791) | 21 | upstream |
| CEP290-983 | - | UAGAGACACAUUCAGUAA (1792) | 18 | upstream |
| CEP290-984 | - | UCAAAAGCUUUUGCUGGCUCA (1793) | 21 | upstream |
| CEP290-985 | + | UCCAUAAGCCUCUAUUUCUGAU (1794) | 22 | upstream |
| CEP290-986 | + | UAAGCCUCUAUUUCUGAU (1795) | 18 | upstream |
| CEP290-987 | + | UAAAUCAUGCAAGUGACCUA (508) | 20 | upstream |
| CEP290-988 | - | UCUUUUAACCAGACAUCU (1796) | 18 | upstream |
| CEP290-989 | + | UUUGUUCUGGGUACAGGGGUAA (1797) | 22 | upstream |
| CEP290-990 | + | UUGUUCUGGGUACAGGGGUAA (1798) | 21 | upstream |
| CEP290-991 | + | UGUUCUGGGUACAGGGGUAA (1799) | 20 | upstream |
| CEP290-992 | + | UUCUGGGUACAGGGGUAA (1800) | 18 | upstream |
| CEP290-993 | + | UGACUCAUAAUUUAGUAGGAAUC (1801) | 23 | upstream |
| CEP290-994 | + | UCAUAAUUUAGUAGGAAUC (1802) | 19 | upstream |

TABLE 8E-continued

| gRNA Name | DNA Strand | Targeting Domain (SEQ ID NO) | Target Site Length | |
|---|---|---|---|---|
| CEP290-995 | − | UGGAAUGGAUGUAGCCAACAGUAG (1803) | 24 | upstream |
| CEP290-996 | − | UGGAUGUAGCCAACAGUAG (1804) | 19 | upstream |
| CEP290-997 | + | UCACCUCUCUUUGGCAAAAGCAG (1805) | 23 | upstream |
| CEP290-998 | + | UCUCUUUGGCAAAAGCAG (1806) | 18 | upstream |
| CEP290-999 | − | UAGAAUAUUGUAAUCAAAGG (1807) | 20 | upstream |
| CEP290-1000 | + | UCCAAGGAACAAAAGCCAGGGACC (1808) | 24 | upstream |
| CEP290-1001 | + | UCCAUUCCAAGGAACAAAAGC (1809) | 21 | upstream |
| CEP290-1002 | + | UUAGAUCUUAUUCUACUCCU (1810) | 20 | upstream |
| CEP290-1003 | + | UAGAUCUUAUUCUACUCCU (1811) | 19 | upstream |
| CEP290-1004 | + | UCUUGCCUAGGACUUUCUAAUGC (1812) | 23 | upstream |
| CEP290-1005 | + | UUGCCUAGGACUUUCUAAUGC (1813) | 21 | upstream |
| CEP290-1006 | + | UGCCUAGGACUUUCUAAUGC (632) | 20 | upstream |
| CEP290-1007 | − | UCCUGAUUUGUUCAUCUUCCUCAU (1814) | 24 | upstream |
| CEP290-1008 | − | UGAUUUGUUCAUCUUCCUCAU (1815) | 21 | upstream |
| CEP290-1009 | − | UUUGUUCAUCUUCCUCAU (1816) | 18 | upstream |
| CEP290-1010 | − | UGAUUAUGUUACUUUUUA (1817) | 18 | upstream |
| CEP290-1011 | − | UCUUUUAACCAGACAUCUAA (1818) | 20 | upstream |
| CEP290-1012 | − | UUUUAACCAGACAUCUAA (1819) | 18 | upstream |
| CEP290-1013 | − | UCUGUCCUAUCCUCUCCAGCAU (1820) | 22 | upstream |
| CEP290-1014 | − | UGUCCUAUCCUCUCCAGCAU (1821) | 20 | upstream |
| CEP290-1015 | − | UCCUAUCCUCUCCAGCAU (1822) | 18 | upstream |
| CEP290-1016 | + | UGAUAAACAUGACUCAUAAUUUAG (1823) | 24 | upstream |
| CEP290-1017 | + | UAAACAUGACUCAUAAUUUAG (1824) | 21 | upstream |
| CEP290-1018 | − | UAGAAUAUUGUAAUCAAAG (1825) | 19 | upstream |
| CEP290-1019 | + | UGUUCUGGGUACAGGGGUAAGAGA (1826) | 24 | upstream |
| CEP290-1020 | + | UUCUGGGUACAGGGGUAAGAGA (1827) | 22 | upstream |
| CEP290-1021 | + | UCUGGGUACAGGGGUAAGAGA (1828) | 21 | upstream |
| CEP290-1022 | + | UGGGUACAGGGGUAAGAGA (1829) | 19 | upstream |
| CEP290-1023 | + | UAGUUUGUUCUGGGUACAGGGGU (1830) | 23 | upstream |
| CEP290-1024 | + | UUUGUUCUGGGUACAGGGGU (1831) | 20 | upstream |
| CEP290-1025 | + | UUGUUCUGGGUACAGGGGU (1832) | 19 | upstream |
| CEP290-1026 | + | UGUUCUGGGUACAGGGGU (1833) | 18 | upstream |
| CEP290-1027 | − | UUUGCUUUCUGCUGCUUUUGCCA (1834) | 23 | upstream |

TABLE 8E-continued

| gRNA Name | DNA Strand | Targeting Domain (SEQ ID NO) | Target Site Length | |
|---|---|---|---|---|
| CEP290-1028 | − | UUUGCUUUCUGCUGCUUUUGCCA (1835) | 22 | upstream |
| CEP290-1029 | − | UGCUUUCUGCUGCUUUUGCCA (1836) | 21 | upstream |
| CEP290-1030 | − | UUUCUGCUGCUUUUGCCA (1837) | 18 | upstream |
| CEP290-1031 | − | UCUAAGAGAAAAAGGAGC (1838) | 18 | upstream |
| CEP290-1032 | + | UGGAGAGGAUAGGACAGAGGACA (1839) | 23 | upstream |
| CEP290-1033 | + | UUAGGAAAGAUGAAAAAUACUCUU (1840) | 24 | upstream |
| CEP290-1034 | + | UAGGAAAGAUGAAAAAUACUCUU (1841) | 23 | upstream |
| CEP290-1035 | + | UAGGAAAGAUGAAAAAUACUCUUU (1842) | 24 | upstream |
| CEP290-1036 | + | UUUAGGAAAGAUGAAAAAUACUCU (1843) | 24 | upstream |
| CEP290-1037 | + | UUAGGAAAGAUGAAAAAUACUCU (1844) | 23 | upstream |
| CEP290-1038 | + | UAGGAAAGAUGAAAAAUACUCU (1845) | 22 | upstream |
| CEP290-1039 | + | UAGGACAGAGGACAUGGAGAA (1846) | 21 | upstream |
| CEP290-1040 | + | UAGGACAGAGGACAUGGAGA (1847) | 20 | upstream |
| CEP290-1041 | + | UUUAUUCUACAAUAAAAAAUG (1848) | 21 | upstream |
| CEP290-1042 | + | UUAUUCUACAAUAAAAAUG (1849) | 20 | upstream |
| CEP290-1043 | + | UAUUCUACAAUAAAAAUG (1850) | 19 | upstream |
| CEP290-1044 | + | UUGUGUGUGUGUGUGUGUUAU (1851) | 23 | upstream |
| CEP290-1045 | + | UGUGUGUGUGUGUGUGUUAU (1852) | 22 | upstream |
| CEP290-1046 | + | UGUGUGUGUGUGUGUUAU (1853) | 20 | upstream |
| CEP290-1047 | + | UGUGUGUGUGUGUUAU (1854) | 18 | upstream |
| CEP290-1048 | + | UUGUGUGUGUGUGUGUGUUAUG (1855) | 24 | upstream |
| CEP290-1049 | + | UGUGUGUGUGUGUGUGUUAUG (1856) | 23 | upstream |
| CEP290-1050 | + | UGUGUGUGUGUGUGUUAUG (1857) | 21 | upstream |
| CEP290-1051 | + | UGUGUGUGUGUGUUAUG (1858) | 19 | upstream |
| CEP290-1052 | + | ACUGUUGGCUACAUCCAUUCCA (1859) | 22 | upstream |
| CEP290-1053 | + | AUUAUCCACAAGAUGUCUCUUGCC (1860) | 24 | upstream |
| CEP290-1054 | + | AUCCACAAGAUGUCUCUUGCC (1861) | 21 | upstream |
| CEP290-1055 | + | AUGAGCCAGCAAAAGCUU (1862) | 18 | upstream |
| CEP290-1056 | + | ACAGAGUGCAUCCAUGGUCCAGG (1863) | 23 | upstream |
| CEP290-1057 | + | AGAGUGCAUCCAUGGUCCAGG (1864) | 21 | upstream |

TABLE 8E-continued

| gRNA Name | DNA Strand | Targeting Domain (SEQ ID NO) | Target Site Length | |
|---|---|---|---|---|
| CEP290-1058 | + | AGUGCAUCCAUGGUCCAGG (1865) | 19 | upstream |
| CEP290-1059 | − | AGCUGAAAUAUUAAGGGCUCUUC (1866) | 23 | upstream |
| CEP290-1060 | − | AAAUAUUAAGGGCUCUUC (1867) | 18 | upstream |
| CEP290-1061 | − | AACUCUAUACCUUUUACUGAGGA (1868) | 23 | upstream |
| CEP290-1062 | − | ACUCUAUACCUUUUACUGAGGA (1869) | 22 | upstream |
| CEP290-1063 | − | ACUUGAACUCUAUACCUUUUACU (1870) | 23 | upstream |
| CEP290-1064 | − | AACUCUAUACCUUUUACU (1871) | 18 | upstream |
| CEP290-1065 | + | AGUAGGAAUCCUGAAAGCUACU (1872) | 22 | upstream |
| CEP290-1066 | + | AGGAAUCCUGAAAGCUACU (1873) | 19 | upstream |
| CEP290-1067 | − | AGCCAACAGUAGCUGAAAUAUU (1874) | 22 | upstream |
| CEP290-1068 | − | AACAGUAGCUGAAAUAUU (1875) | 18 | upstream |
| CEP290-1069 | + | AUCCAUUCCAAGGAACAAAAGCC (1876) | 23 | upstream |
| CEP290-1070 | + | AUUCCAAGGAACAAAAGCC (1877) | 19 | upstream |
| CEP290-1071 | − | AUCCCUUUCUCUUACCCCUGUACC (1878) | 24 | upstream |
| CEP290-1072 | + | AGGACUUUCUAAUGCUGGAGAGGA (1879) | 24 | upstream |
| CEP290-1073 | + | ACUUUCUAAUGCUGGAGAGGA (1880) | 21 | upstream |
| CEP290-1074 | + | AAUGCUGGAGAGGAUAGGACA (1881) | 21 | upstream |
| CEP290-1075 | + | AUGCUGGAGAGGAUAGGACA (1882) | 20 | upstream |
| CEP290-1076 | − | AUCAUAAGUUACAAUCUGUGAAU (1883) | 23 | upstream |
| CEP290-1077 | − | AUAAGUUACAAUCUGUGAAU (1884) | 20 | upstream |
| CEP290-1078 | − | AAGUUACAAUCUGUGAAU (1885) | 18 | upstream |
| CEP290-1079 | − | AACCAGACAUCUAAGAGAAAA (1886) | 21 | upstream |
| CEP290-1080 | − | ACCAGACAUCUAAGAGAAAA (1887) | 20 | upstream |
| CEP290-1081 | + | AAGCCUCUAUUUCUGAUGAGGAAG (1888) | 24 | upstream |
| CEP290-1082 | + | AGCCUCUAUUUCUGAUGAGGAAG (1889) | 23 | upstream |
| CEP290-1083 | + | AUGAGGAAGAUGAACAAAUC (1890) | 20 | upstream |
| CEP290-1084 | + | AUUUACUGAAUGUGUCUCU (1891) | 19 | upstream |
| CEP290-1085 | + | ACAGGGGUAAGAGAAAGGG (1892) | 19 | upstream |
| CEP290-1086 | + | CUACUGUUGGCUACAUCCAUUCCA (1893) | 24 | upstream |
| CEP290-1087 | + | CUGUUGGCUACAUCCAUUCCA (1894) | 21 | upstream |
| CEP290-1088 | + | CCACAAGAUGUCUCUUGCC (1895) | 19 | upstream |
| CEP290-1089 | + | CACAAGAUGUCUCUUGCC (1896) | 18 | upstream |

TABLE 8E-continued

| gRNA Name | DNA Strand | Targeting Domain (SEQ ID NO) | Target Site Length | |
|---|---|---|---|---|
| CEP290-1090 | − | CCUUUGUAGUUAUCUUACAGCCAC (1897) | 24 | upstream |
| CEP290-1091 | − | CUUUGUAGUUAUCUUACAGCCAC (1898) | 23 | upstream |
| CEP290-1092 | + | CUCUAUGAGCCAGCAAAAGCUU (1899) | 22 | upstream |
| CEP290-1093 | + | CUAUGAGCCAGCAAAAGCUU (1900) | 20 | upstream |
| CEP290-1094 | + | CAGAGUGCAUCCAUGGUCCAGG (1901) | 22 | upstream |
| CEP290-1095 | − | CUGAAAUAUUAAGGGCUCUUC (1902) | 21 | upstream |
| CEP290-1096 | − | CUCUAUACCUUUUACUGAGGA (1903) | 21 | upstream |
| CEP290-1097 | − | CUAUACCUUUUACUGAGGA (1904) | 19 | upstream |
| CEP290-1098 | − | CACUUGAACUCUAUACCUUUUACU (1905) | 24 | upstream |
| CEP290-1099 | − | CUUGAACUCUAUACCUUUUACU (1906) | 22 | upstream |
| CEP290-1100 | − | CCAACAGUAGCUGAAAUAUU (1907) | 20 | upstream |
| CEP290-1101 | − | CAACAGUAGCUGAAAUAUU (1908) | 19 | upstream |
| CEP290-1102 | + | CAUCCAUUCCAAGGAACAAAAGCC (1909) | 24 | upstream |
| CEP290-1103 | + | CCAUUCCAAGGAACAAAAGCC (1910) | 21 | upstream |
| CEP290-1104 | + | CAUUCCAAGGAACAAAAGCC (1911) | 20 | upstream |
| CEP290-1105 | − | CCCUUUCUCUUACCCCUGUACC (1912) | 22 | upstream |
| CEP290-1106 | − | CCUUUCUCUUACCCCUGUACC (1913) | 21 | upstream |
| CEP290-1107 | − | CUUUCUCUUACCCCUGUACC (1914) | 20 | upstream |
| CEP290-1108 | + | CUUUCUAAUGCUGGAGAGGA (1915) | 20 | upstream |
| CEP290-1109 | + | CUAAUGCUGGAGAGGAUAGGACA (1916) | 23 | upstream |
| CEP290-1110 | − | CAUAAGUUACAAUCUGUGAAU (1917) | 21 | upstream |
| CEP290-1111 | − | CCAGACAUCUAAGAGAAAA (1918) | 19 | upstream |
| CEP290-1112 | − | CAGACAUCUAAGAGAAAA (1919) | 18 | upstream |
| CEP290-1113 | + | CCUCUAUUUCUGAUGAGGAAG (1920) | 21 | upstream |
| CEP290-1114 | + | CUCUAUUUCUGAUGAGGAAG (1921) | 20 | upstream |
| CEP290-1115 | + | CUAUUUCUGAUGAGGAAG (1922) | 18 | upstream |
| CEP290-1116 | + | CUGAUGAGGAAGAUGAACAAAUC (1923) | 23 | upstream |
| CEP290-1117 | + | CAUUUACUGAAUGUGUCUCU (1924) | 20 | upstream |
| CEP290-1118 | + | CAGGGGUAAGAGAAAGGG (1925) | 18 | upstream |
| CEP290-1119 | + | GUUGGCUACAUCCAUUCCA (1926) | 19 | upstream |
| CEP290-1120 | − | GUAGUUAUCUUACAGCCAC (1927) | 19 | upstream |
| CEP290-1121 | + | GUCUCUAUGAGCCAGCAAAAGCUU (1928) | 24 | upstream |
| CEP290-1122 | + | GAGUGCAUCCAUGGUCCAGG (1929) | 20 | upstream |
| CEP290-1123 | + | GUGCAUCCAUGGUCCAGG (1930) | 18 | upstream |

TABLE 8E-continued

| gRNA Name | DNA Strand | Targeting Domain (SEQ ID NO) | Target Site Length | |
|---|---|---|---|---|
| CEP290-1124 | − | GCUGAAAUAUUAAGGGCUCUUC (1931) | 22 | upstream |
| CEP290-1125 | − | GAAAUAUUAAGGGCUCUUC (1932) | 19 | upstream |
| CEP290-1126 | − | GAACUCUAUACCUUUUACUGAGGA (1933) | 24 | upstream |
| CEP290-1127 | − | GAACUCUAUACCUUUUACU (1934) | 19 | upstream |
| CEP290-1128 | + | GUAGGAAUCCUGAAAGCUACU (1935) | 21 | upstream |
| CEP290-1129 | + | GGAAUCCUGAAAGCUACU (1936) | 18 | upstream |
| CEP290-1130 | − | GUAGCCAACAGUAGCUGAAAUAUU (1937) | 24 | upstream |
| CEP290-1131 | − | GCCAACAGUAGCUGAAAUAUU (1938) | 21 | upstream |
| CEP290-1132 | + | GGACUUUCUAAUGCUGGAGAGGA (1939) | 23 | upstream |
| CEP290-1133 | + | GACUUUCUAAUGCUGGAGAGGA (1940) | 22 | upstream |
| CEP290-1134 | + | GCUGGAGAGGAUAGGACA (1941) | 18 | upstream |
| CEP290-1135 | + | GCCUCUAUUUCUGAUGAGGAAG (1942) | 22 | upstream |
| CEP290-1136 | + | GAUGAGGAAGAUGAACAAAUC (1943) | 21 | upstream |
| CEP290-1137 | + | GAGGAAGAUGAACAAAUC (1944) | 18 | upstream |
| CEP290-1138 | + | GGGUACAGGGGUAAGAGAAAGGG (1945) | 23 | upstream |
| CEP290-1139 | + | GGUACAGGGGUAAGAGAAAGGG (1946) | 22 | upstream |
| CEP290-1140 | + | GUACAGGGGUAAGAGAAAGGG (1947) | 21 | upstream |
| CEP290-1141 | + | GUGUGUGUGUGUGUGUUAUGU (1948) | 23 | upstream |
| CEP290-1142 | + | GUGUGUGUGUGUGUUAUGU (1949) | 21 | upstream |
| CEP290-1143 | + | GUGUGUGUGUGUUAUGU (1950) | 19 | upstream |
| CEP290-1144 | + | UACUGUUGGCUACAUCCAUUCCA (1951) | 23 | upstream |
| CEP290-1145 | + | UGUUGGCUACAUCCAUUCCA (1952) | 20 | upstream |
| CEP290-1146 | + | UUGGCUACAUCCAUUCCA (1953) | 18 | upstream |
| CEP290-1147 | + | UUAUCCACAAGAUGUCUCUUGCC (1954) | 23 | upstream |
| CEP290-1148 | + | UAUCCACAAGAUGUCUCUUGCC (1955) | 22 | upstream |
| CEP290-1149 | + | UCCACAAGAUGUCUCUUGCC (1956) | 20 | upstream |
| CEP290-1150 | − | UUUGUAGUUAUCUUACAGCCAC (1957) | 22 | upstream |
| CEP290-1151 | − | UUGUAGUUAUCUUACAGCCAC (1958) | 21 | upstream |
| CEP290-1152 | − | UGUAGUUAUCUUACAGCCAC (1959) | 20 | upstream |
| CEP290-1153 | − | UAGUUAUCUUACAGCCAC (1960) | 18 | upstream |
| CEP290-1154 | + | UCUCUAUGAGCCAGCAAAAGCUU (1961) | 23 | upstream |

TABLE 8E-continued

| gRNA Name | DNA Strand | Targeting Domain (SEQ ID NO) | Target Site Length | |
|---|---|---|---|---|
| CEP290-1155 | + | UCUAUGAGCCAGCAAAAGCUU (1962) | 21 | upstream |
| CEP290-1156 | + | UAUGAGCCAGCAAAAGCUU (1963) | 19 | upstream |
| CEP290-1157 | + | UACAGAGUGCAUCCAUGGUCCAGG (1964) | 24 | upstream |
| CEP290-1158 | − | UAGCUGAAAUAUUAAGGGCUCUUC (1965) | 24 | upstream |
| CEP290-1159 | − | UGAAAUAUUAAGGGCUCUUC (1966) | 20 | upstream |
| CEP290-1160 | − | UCUAUACCUUUUACUGAGGA (1967) | 20 | upstream |
| CEP290-1161 | − | UAUACCUUUUACUGAGGA (1968) | 18 | upstream |
| CEP290-1162 | − | UUGAACUCUAUACCUUUUACU (1969) | 21 | upstream |
| CEP290-1163 | − | UGAACUCUAUACCUUUUACU (1970) | 20 | upstream |
| CEP290-1164 | + | UUAGUAGGAAUCCUGAAAGCUACU (1971) | 24 | upstream |
| CEP290-1165 | + | UAGUAGGAAUCCUGAAAGCUACU (1972) | 23 | upstream |
| CEP290-1166 | + | UAGGAAUCCUGAAAGCUACU (1973) | 20 | upstream |
| CEP290-1167 | − | UAGCCAACAGUAGCUGAAAUAUU (1974) | 23 | upstream |
| CEP290-1168 | + | UCCAUUCCAAGGAACAAAAGCC (1975) | 22 | upstream |
| CEP290-1169 | + | UUCCAAGGAACAAAAGCC (1976) | 18 | upstream |
| CEP290-1170 | − | UCCCUUUCUCUUACCCCUGUACC (1977) | 23 | upstream |
| CEP290-1171 | − | UUUCUCUUACCCCUGUACC (1978) | 19 | upstream |
| CEP290-1172 | − | UUCUCUUACCCCUGUACC (1979) | 18 | upstream |
| CEP290-1173 | + | UUUCUAAUGCUGGAGAGGA (1980) | 19 | upstream |
| CEP290-1174 | + | UUCUAAUGCUGGAGAGGA (1981) | 18 | upstream |
| CEP290-1175 | + | UCUAAUGCUGGAGAGGAUAGGACA (1982) | 24 | upstream |
| CEP290-1176 | + | UAAUGCUGGAGAGGAUAGGACA (1983) | 22 | upstream |
| CEP290-1177 | + | UGCUGGAGAGGAUAGGACA (1984) | 19 | upstream |
| CEP290-1178 | − | UAUCAUAAGUUACAAUCUGUGAAU (1985) | 24 | upstream |
| CEP290-1179 | − | UCAUAAGUUACAAUCUGUGAAU (1986) | 22 | upstream |
| CEP290-1180 | − | UAAGUUACAAUCUGUGAAU (1987) | 19 | upstream |
| CEP290-1181 | − | UUUAACCAGACAUCUAAGAGAAAA (1988) | 24 | upstream |
| CEP290-1182 | − | UUAACCAGACAUCUAAGAGAAAA (1989) | 23 | upstream |
| CEP290-1183 | − | UAACCAGACAUCUAAGAGAAAA (1990) | 22 | upstream |
| CEP290-1184 | + | UCUAUUUCUGAUGAGGAAG (1991) | 19 | upstream |
| CEP290-1185 | + | UCUGAUGAGGAAGAUGAACAAAUC (1992) | 24 | upstream |

TABLE 8E-continued

| gRNA Name | DNA Strand | Targeting Domain (SEQ ID NO) | Target Site Length | |
|---|---|---|---|---|
| CEP290-1186 | + | UGAUGAGGAAGAUGAACAAAUC (1993) | 22 | upstream |
| CEP290-1187 | + | UGAGGAAGAUGAACAAAUC (1994) | 19 | upstream |
| CEP290-1188 | + | UUUUCAUUUACUGAAUGUGUCUCU (1995) | 24 | upstream |
| CEP290-1189 | + | UUUCAUUUACUGAAUGUGUCUCU (1996) | 23 | upstream |
| CEP290-1190 | + | UUCAUUUACUGAAUGUGUCUCU (1997) | 22 | upstream |
| CEP290-1191 | + | UCAUUUACUGAAUGUGUCUCU (1998) | 21 | upstream |
| CEP290-1192 | + | UUUACUGAAUGUGUCUCU (1999) | 18 | upstream |
| CEP290-1193 | + | UGGGUACAGGGGUAAGAGAAAGGG (2000) | 24 | upstream |
| CEP290-1194 | + | UACAGGGGUAAGAGAAAGGG (2001) | 20 | upstream |
| CEP290-1195 | + | UGUGUGUGUGUGUGUGUUAUGU (2002) | 24 | upstream |
| CEP290-1196 | + | UGUGUGUGUGUGUGUUAUGU (2003) | 22 | upstream |
| CEP290-1197 | + | UGUGUGUGUGUGUUAUGU (2004) | 20 | upstream |
| CEP290-1198 | + | UGUGUGUGUGUUAUGU (2005) | 18 | upstream |
| CEP290-1199 | + | AUUUACAGAGUGCAUCCAUGGUCC (2006) | 24 | upstream |
| CEP290-1200 | + | ACAGAGUGCAUCCAUGGUCC (2007) | 20 | upstream |
| CEP290-1201 | + | AGAGUGCAUCCAUGGUCC (2008) | 18 | upstream |
| CEP290-1202 | − | ACUUGAACUCUAUACCUUUUA (2009) | 21 | upstream |
| CEP290-1203 | + | AGCUAAAUCAUGCAAGUGACCU (2010) | 22 | upstream |
| CEP290-1204 | + | AAAUCAUGCAAGUGACCU (2011) | 18 | upstream |
| CEP290-1205 | + | AUCCAUAAGCCUCUAUUUCUGAUG (2012) | 24 | upstream |
| CEP290-1206 | + | AUAAGCCUCUAUUUCUGAUG (2013) | 20 | upstream |
| CEP290-1207 | + | AAGCCUCUAUUUCUGAUG (2014) | 18 | upstream |
| CEP290-1208 | + | AGAAUAGUUUGUUCUGGGUA (2015) | 20 | upstream |
| CEP290-1209 | + | AAUAGUUUGUUCUGGGUA (2016) | 18 | upstream |
| CEP290-1210 | + | AGGAGAAUGAUCUAGAUAAUCAUU (2017) | 24 | upstream |
| CEP290-1211 | + | AGAAUGAUCUAGAUAAUCAUU (2018) | 21 | upstream |
| CEP290-1212 | + | AAUGAUCUAGAUAAUCAUU (2019) | 19 | upstream |
| CEP290-1213 | + | AUGAUCUAGAUAAUCAUU (2020) | 18 | upstream |
| CEP290-1214 | + | AAUGCUGGAGAGGAUAGGA (2021) | 19 | upstream |
| CEP290-1215 | + | AUGCUGGAGAGGAUAGGA (2022) | 18 | upstream |
| CEP290-1216 | + | AAAAUCCAUAAGCCUCUAUUUCUG (2023) | 24 | upstream |
| CEP290-1217 | + | AAAUCCAUAAGCCUCUAUUUCUG (2024) | 23 | upstream |

TABLE 8E-continued

| gRNA Name | DNA Strand | Targeting Domain (SEQ ID NO) | Target Site Length | |
|---|---|---|---|---|
| CEP290-1218 | + | AAUCCAUAAGCCUCUAUUUCUG (2025) | 22 | upstream |
| CEP290-1219 | + | AUCCAUAAGCCUCUAUUUCUG (2026) | 21 | upstream |
| CEP290-1220 | − | AAACAGGUAGAAUAUUGUAAUCA (2027) | 23 | upstream |
| CEP290-1221 | − | AACAGGUAGAAUAUUGUAAUCA (2028) | 22 | upstream |
| CEP290-1222 | − | ACAGGUAGAAUAUUGUAAUCA (2029) | 21 | upstream |
| CEP290-1223 | − | AGGUAGAAUAUUGUAAUCA (2030) | 19 | upstream |
| CEP290-1224 | + | AAGGAACAAAGCCAGGGACCA (2031) | 22 | upstream |
| CEP290-1225 | + | AGGAACAAAGCCAGGGACCA (2032) | 21 | upstream |
| CEP290-1226 | + | AACAAAGCCAGGGACCA (2033) | 18 | upstream |
| CEP290-1227 | − | AGGUAGAAUAUUGUAAUCAAAGGA (2034) | 24 | upstream |
| CEP290-1228 | − | AGAAUAUUGUAAUCAAAGGA (2035) | 20 | upstream |
| CEP290-1229 | − | AAUAUUGUAAUCAAAGGA (2036) | 18 | upstream |
| CEP290-1230 | − | AGUCAUGUUUAUCAAUAUUAUU (2037) | 22 | upstream |
| CEP290-1231 | − | AUGUUUAUCAAUAUUAUU (2038) | 18 | upstream |
| CEP290-1232 | − | AACCAGACAUCUAAGAGAAA (2039) | 20 | upstream |
| CEP290-1233 | − | ACCAGACAUCUAAGAGAAA (2040) | 19 | upstream |
| CEP290-1234 | − | AUUCUUAUCUAAGAUCCUUUCA (2041) | 22 | upstream |
| CEP290-1235 | − | AAACAGGUAGAAUAUUGUAAUCAA (2042) | 24 | upstream |
| CEP290-1236 | − | AACAGGUAGAAUAUUGUAAUCAA (2043) | 23 | upstream |
| CEP290-1237 | − | ACAGGUAGAAUAUUGUAAUCAA (2044) | 22 | upstream |
| CEP290-1238 | − | AGGUAGAAUAUUGUAAUCAA (2045) | 20 | upstream |
| CEP290-1239 | + | AUGAGGAAGAUGAACAAAU (2046) | 19 | upstream |
| CEP290-1240 | + | AGAGGAUAGGACAGAGGAC (2047) | 19 | upstream |
| CEP290-1241 | + | CAGAGUGCAUCCAUGGUCC (2048) | 19 | upstream |
| CEP290-1242 | + | CUUGCCUAGGACUUUCUAAUGCUG (2049) | 24 | upstream |
| CEP290-1243 | + | CCUAGGACUUUCUAAUGCUG (2050) | 20 | upstream |
| CEP290-1244 | + | CUAGGACUUUCUAAUGCUG (2051) | 19 | upstream |
| CEP290-1245 | − | CCACUUGAACUCUAUACCUUUA (2052) | 23 | upstream |
| CEP290-1246 | − | CACUUGAACUCUAUACCUUUA (2053) | 22 | upstream |
| CEP290-1247 | − | CUUGAACUCUAUACCUUUA (2054) | 20 | upstream |
| CEP290-1248 | + | CAGCUAAAUCAUGCAAGUGACCU (2055) | 23 | upstream |
| CEP290-1249 | + | CUAAAUCAUGCAAGUGACCU (2056) | 20 | upstream |

TABLE 8E-continued

| gRNA Name | DNA Strand | Targeting Domain (SEQ ID NO) | Target Site Length | |
|---|---|---|---|---|
| CEP290-1250 | + | CUCUUGCCUAGGACUUUCUAAUG (2057) | 23 | upstream |
| CEP290-1251 | + | CUUGCCUAGGACUUUCUAAUG (2058) | 21 | upstream |
| CEP290-1252 | + | CCAUAAGCCUCUAUUUCUGAUG (2059) | 22 | upstream |
| CEP290-1253 | + | CAUAAGCCUCUAUUUCUGAUG (2060) | 21 | upstream |
| CEP290-1254 | + | CUAAUGCUGGAGAGGAUAGGA (2061) | 21 | upstream |
| CEP290-1255 | + | CCAUAAGCCUCUAUUUCUG (2062) | 19 | upstream |
| CEP290-1256 | + | CAUAAGCCUCUAUUUCUG (2063) | 18 | upstream |
| CEP290-1257 | − | CAGGUAGAAUAUUGUAAUCA (2064) | 20 | upstream |
| CEP290-1258 | − | CUUUCUGCUGCUUUUGCCAAA (2065) | 21 | upstream |
| CEP290-1259 | + | CCAAGGAACAAAAGCCAGGGACCA (2066) | 24 | upstream |
| CEP290-1260 | + | CAAGGAACAAAAGCCAGGGACCA (2067) | 23 | upstream |
| CEP290-1261 | + | CUCUUAGAUGUCUGGUUAA (2068) | 19 | upstream |
| CEP290-1262 | − | CAUGUUUAUCAAUAUUAUU (2069) | 19 | upstream |
| CEP290-1263 | − | CCAGACAUCUAAGAGAAA (2070) | 18 | upstream |
| CEP290-1264 | − | CUUAUCUAAGAUCCUUUCA (2071) | 19 | upstream |
| CEP290-1265 | − | CAGGUAGAAUAUUGUAAUCAA (2072) | 21 | upstream |
| CEP290-1266 | + | CUGAUGAGGAAGAUGAACAAAU (2073) | 22 | upstream |
| CEP290-1267 | + | CUGGAGAGGAUAGGACAGAGGAC (2074) | 23 | upstream |
| CEP290-1268 | − | CAUCUUCCUCAUCAGAAA (2075) | 18 | upstream |
| CEP290-1269 | + | GCCUAGGACUUUCUAAUGCUG (2076) | 21 | upstream |
| CEP290-1270 | − | GCCACUUGAACUCUAUACCUUUUA (2077) | 24 | upstream |
| CEP290-1271 | + | GCUAAAUCAUGCAAGUGACCU (2078) | 21 | upstream |
| CEP290-1272 | + | GCCUAGGACUUUCUAAUG (2079) | 18 | upstream |
| CEP290-1273 | + | GGGAGAAUAGUUUGUUCUGGGUA (2080) | 23 | upstream |
| CEP290-1274 | + | GGAGAAUAGUUUGUUCUGGGUA (2081) | 22 | upstream |
| CEP290-1275 | + | GAGAAUAGUUUGUUCUGGGUA (2082) | 21 | upstream |
| CEP290-1276 | + | GAAUAGUUUGUUCUGGGUA (2083) | 19 | upstream |
| CEP290-1277 | + | GGAGAAUGAUCUAGAUAAUCAUU (2084) | 23 | upstream |
| CEP290-1278 | + | GAGAAUGAUCUAGAUAAUCAUU (2085) | 22 | upstream |
| CEP290-1279 | + | GAAUGAUCUAGAUAAUCAUU (2086) | 20 | upstream |
| CEP290-1280 | − | GAAACAGGUAGAAUAUUGUAAUCA (2087) | 24 | upstream |
| CEP290-1281 | − | GGUAGAAUAUUGUAAUCA (2088) | 18 | upstream |

TABLE 8E-continued

| gRNA Name | DNA Strand | Targeting Domain (SEQ ID NO) | Target Site Length | |
|---|---|---|---|---|
| CEP290-1282 | − | GCUUUCUGCUGCUUUUGCCAAA (2089) | 22 | upstream |
| CEP290-1283 | + | GGAACAAAAGCCAGGGACCA (484) | 20 | upstream |
| CEP290-1284 | + | GAACAAAAGCCAGGGACCA (2090) | 19 | upstream |
| CEP290-1285 | − | GGUAGAAUAUUGUAAUCAAAGGA (2091) | 23 | upstream |
| CEP290-1286 | − | GUAGAAUAUUGUAAUCAAAGGA (2092) | 22 | upstream |
| CEP290-1287 | − | GAAUAUUGUAAUCAAAGGA (2093) | 19 | upstream |
| CEP290-1288 | − | GAGUCAUGUUUAUCAAUAUUAUU (2094) | 23 | upstream |
| CEP290-1289 | − | GUCAUGUUUAUCAAUAUUAUU (2095) | 21 | upstream |
| CEP290-1290 | − | GGUAGAAUAUUGUAAUCAA (2096) | 19 | upstream |
| CEP290-1291 | − | GUAGAAUAUUGUAAUCAA (2097) | 18 | upstream |
| CEP290-1292 | + | GAUGAGGAAGAUGAACAAAU (2098) | 20 | upstream |
| CEP290-1293 | + | GCUGGAGAGGAUAGGACAGAGGAC (2099) | 24 | upstream |
| CEP290-1294 | + | GGAGAGGAUAGGACAGAGGAC (2100) | 21 | upstream |
| CEP290-1295 | + | GAGAGGAUAGGACAGAGGAC (2101) | 20 | upstream |
| CEP290-1296 | + | GAGGAUAGGACAGAGGAC (2102) | 18 | upstream |
| CEP290-1297 | − | GUUCAUCUUCCUCAUCAGAAA (2103) | 21 | upstream |
| CEP290-1298 | + | UUUACAGAGUGCAUCCAUGGUCC (2104) | 23 | upstream |
| CEP290-1299 | + | UUACAGAGUGCAUCCAUGGUCC (2105) | 22 | upstream |
| CEP290-1300 | + | UACAGAGUGCAUCCAUGGUCC (2106) | 21 | upstream |
| CEP290-1301 | + | UUGCCUAGGACUUUCUAAUGCUG (2107) | 23 | upstream |
| CEP290-1302 | + | UGCCUAGGACUUUCUAAUGCUG (2108) | 22 | upstream |
| CEP290-1303 | + | UAGGACUUUCUAAUGCUG (2109) | 18 | upstream |
| CEP290-1304 | − | UUGAACUCUAUACCUUUUA (2110) | 19 | upstream |
| CEP290-1305 | − | UGAACUCUAUACCUUUUA (2111) | 18 | upstream |
| CEP290-1306 | + | UCAGCUAAAUCAUGCAAGUGACCU (2112) | 24 | upstream |
| CEP290-1307 | + | UAAAUCAUGCAAGUGACCU (2113) | 19 | upstream |
| CEP290-1308 | + | UCUCUUGCCUAGGACUUUCUAAUG (2114) | 24 | upstream |
| CEP290-1309 | + | UCUUGCCUAGGACUUUCUAAUG (2115) | 22 | upstream |
| CEP290-1310 | + | UUGCCUAGGACUUUCUAAUG (2116) | 20 | upstream |
| CEP290-1311 | + | UGCCUAGGACUUUCUAAUG (2117) | 19 | upstream |
| CEP290-1312 | + | UCCAUAAGCCUCUAUUUCUGAUG (2118) | 23 | upstream |

TABLE 8E-continued

| gRNA Name | DNA Strand | Targeting Domain (SEQ ID NO) | Target Site Length | |
|---|---|---|---|---|
| CEP290-1313 | + | UAAGCCUCUAUUUCUGAUG (2119) | 19 | upstream |
| CEP290-1314 | + | UGGGAGAAUAGUUUGUUCUGGGUA (2120) | 24 | upstream |
| CEP290-1315 | + | UUUCUAAUGCUGGAGAGGAUAGGA (2121) | 24 | upstream |
| CEP290-1316 | + | UUCUAAUGCUGGAGAGGAUAGGA (2122) | 23 | upstream |
| CEP290-1317 | + | UCUAAUGCUGGAGAGGAUAGGA (2123) | 22 | upstream |
| CEP290-1318 | + | UAAUGCUGGAGAGGAUAGGA (2124) | 20 | upstream |
| CEP290-1319 | + | UCCAUAAGCCUCUAUUUCUG (2125) | 20 | upstream |
| CEP290-1320 | − | UUGCUUUCUGCUGCUUUUGCCAAA (2126) | 24 | upstream |
| CEP290-1321 | − | UGCUUUCUGCUGCUUUUGCCAAA (2127) | 23 | upstream |
| CEP290-1322 | − | UUUCUGCUGCUUUUGCCAAA (2128) | 20 | upstream |
| CEP290-1323 | − | UUCUGCUGCUUUUGCCAAA (2129) | 19 | upstream |
| CEP290-1324 | − | UCUGCUGCUUUUGCCAAA (2130) | 18 | upstream |
| CEP290-1325 | − | UAGAAUAUUGUAAUCAAAGGA (2131) | 21 | upstream |
| CEP290-1326 | + | UUUUUCUCUUAGAUGUCUGGUUAA (2132) | 24 | upstream |
| CEP290-1327 | + | UUUUCUCUUAGAUGUCUGGUUAA (2133) | 23 | upstream |
| CEP290-1328 | + | UUUCUCUUAGAUGUCUGGUUAA (2134) | 22 | upstream |
| CEP290-1329 | + | UUCUCUUAGAUGUCUGGUUAA (2135) | 21 | upstream |
| CEP290-1330 | + | UCUCUUAGAUGUCUGGUUAA (2136) | 20 | upstream |
| CEP290-1331 | + | UCUUAGAUGUCUGGUUAA (2137) | 18 | upstream |
| CEP290-1332 | − | UGAGUCAUGUUUAUCAAUAUUAUU (2138) | 24 | upstream |
| CEP290-1333 | − | UCAUGUUUAUCAAUAUUAUU (2139) | 20 | upstream |
| CEP290-1334 | − | UUUUAACCAGACAUCUAAGAGAAA (2140) | 24 | upstream |
| CEP290-1335 | − | UUUAACCAGACAUCUAAGAGAAA (2141) | 23 | upstream |
| CEP290-1336 | − | UUAACCAGACAUCUAAGAGAAA (2142) | 22 | upstream |
| CEP290-1337 | − | UAACCAGACAUCUAAGAGAAA (2143) | 21 | upstream |
| CEP290-1338 | − | UUAUUCUUAUCUAAGAUCCUUUCA (2144) | 24 | upstream |
| CEP290-1339 | − | UAUUCUUAUCUAAGAUCCUUUCA (2145) | 23 | upstream |
| CEP290-1340 | − | UUCUUAUCUAAGAUCCUUUCA (2146) | 21 | upstream |
| CEP290-1341 | − | UCUUAUCUAAGAUCCUUUCA (2147) | 20 | upstream |
| CEP290-1342 | − | UUAUCUAAGAUCCUUUCA (2148) | 18 | upstream |

TABLE 8E-continued

| gRNA Name | DNA Strand | Targeting Domain (SEQ ID NO) | Target Site Length | |
|---|---|---|---|---|
| CEP290-1343 | + | UUCUGAUGAGGAAGAUGAACAAAU (2149) | 24 | upstream |
| CEP290-1344 | + | UCUGAUGAGGAAGAUGAACAAAU (2150) | 23 | upstream |
| CEP290-1345 | + | UGAUGAGGAAGAUGAACAAAU (2151) | 21 | upstream |
| CEP290-1346 | + | UGAGGAAGAUGAACAAAU (2152) | 18 | upstream |
| CEP290-1347 | + | UGGAGAGGAUAGGACAGAGGAC (2153) | 22 | upstream |
| CEP290-1348 | − | UUUGUUCAUCUUCCUCAUCAGAAA (2154) | 24 | upstream |
| CEP290-1349 | − | UUGUUCAUCUUCCUCAUCAGAAA (2155) | 23 | upstream |
| CEP290-1350 | − | UGUUCAUCUUCCUCAUCAGAAA (2156) | 22 | upstream |
| CEP290-1351 | − | UUCAUCUUCCUCAUCAGAAA (2157) | 20 | upstream |
| CEP290-1352 | − | UCAUCUUCCUCAUCAGAAA (2158) | 19 | upstream |
| CEP290-1353 | − | ACUUACCUCAUGUCAUCUAGAGC (2159) | 23 | downstream |
| CEP290-1354 | − | ACCUCAUGUCAUCUAGAGC (2160) | 19 | downstream |
| CEP290-1355 | + | ACAGUUUUAAGGCGGGGAGUCAC (2161) | 24 | downstream |
| CEP290-1356 | + | AGUUUUAAGGCGGGGAGUCAC (2162) | 22 | downstream |
| CEP290-1357 | − | ACAGAGUUCAAGCUAAUAC (2163) | 19 | downstream |
| CEP290-1358 | + | AUUAGCUUGAACUCUGUGCCAAAC (2164) | 24 | downstream |
| CEP290-1359 | + | AGCUUGAACUCUGUGCCAAAC (2165) | 21 | downstream |
| CEP290-1360 | − | AUGUGGUGUCAAAUAUGGUGCU (2166) | 22 | downstream |
| CEP290-1361 | − | AUGUGGUGUCAAAUAUGGUGCUU (2167) | 23 | downstream |
| CEP290-1362 | + | AGAUGACAUGAGGUAAGU (2168) | 18 | downstream |
| CEP290-1363 | − | AAUACAUGAGAGUGAUUAGUGG (2169) | 22 | downstream |
| CEP290-1364 | − | AUACAUGAGAGUGAUUAGUGG (2170) | 21 | downstream |
| CEP290-1365 | − | ACAUGAGAGUGAUUAGUGG (2171) | 19 | downstream |
| CEP290-16 | + | AAGACACUGCCAAUAGGGAUAGGU (2172) | 24 | downstream |
| CEP290-1366 | + | AGACACUGCCAAUAGGGAUAGGU (2173) | 23 | downstream |
| CEP290-1367 | + | ACACUGCCAAUAGGGAUAGGU (2174) | 21 | downstream |
| CEP290-510 | + | ACUGCCAAUAGGGAUAGGU (2175) | 19 | downstream |
| CEP290-1368 | − | AAAGGUUCAUGAGACUAGAGGUC (2176) | 23 | downstream |
| CEP290-1369 | − | AAGGUUCAUGAGACUAGAGGUC (2177) | 22 | downstream |

TABLE 8E-continued

| gRNA Name | DNA Strand | Targeting Domain (SEQ ID NO) | Target Site Length | |
|---|---|---|---|---|
| CEP290-1370 | − | AGGUUCAUGAGACUAGAGGUC (2178) | 21 | downstream |
| CEP290-1371 | + | AAACAGGAGAUACUCAACACA (2179) | 21 | downstream |
| CEP290-1372 | + | AACAGGAGAUACUCAACACA (2180) | 20 | downstream |
| CEP290-1373 | + | ACAGGAGAUACUCAACACA (2181) | 19 | downstream |
| CEP290-1374 | + | AGCACGUACAAAAGAACAUACAU (2182) | 23 | downstream |
| CEP290-1375 | + | ACGUACAAAAGAACAUACAU (2183) | 20 | downstream |
| CEP290-1376 | + | AGUAAGGAGGAUGUAAGAC (2184) | 19 | downstream |
| CEP290-1377 | + | AGCUUUUGACAGUUUUUAAGG (2185) | 21 | downstream |
| CEP290-1378 | − | ACGUGCUCUUUUCUAUAUAU (622) | 20 | downstream |
| CEP290-1379 | + | AAAUUCACUGAGCAAAACAACUGG (2186) | 24 | downstream |
| CEP290-1380 | + | AAUUCACUGAGCAAAACAACUGG (2187) | 23 | downstream |
| CEP290-1381 | + | AUUCACUGAGCAAAACAACUGG (2188) | 22 | downstream |
| CEP290-1382 | + | ACUGAGCAAAACAACUGG (2189) | 18 | downstream |
| CEP290-1383 | + | AACAAGUUUUGAAACAGGAA (2190) | 20 | downstream |
| CEP290-1384 | + | ACAAGUUUUGAAACAGGAA (2191) | 19 | downstream |
| CEP290-1385 | + | AAUGCCUGAACAAGUUUUGAAA (2192) | 22 | downstream |
| CEP290-1386 | + | AUGCCUGAACAAGUUUUGAAA (2193) | 21 | downstream |
| CEP290-1387 | + | AUUCACUGAGCAAAACAACUGGAA (2194) | 24 | downstream |
| CEP290-1388 | + | ACUGAGCAAAACAACUGGAA (2195) | 20 | downstream |
| CEP290-1389 | + | AAAAAGGUAAUGCCUGAACAAGUU (2196) | 24 | downstream |
| CEP290-1390 | + | AAAAGGUAAUGCCUGAACAAGUU (2197) | 23 | downstream |
| CEP290-1391 | + | AAAGGUAAUGCCUGAACAAGUU (2198) | 22 | downstream |
| CEP290-1392 | + | AAGGUAAUGCCUGAACAAGUU (2199) | 21 | downstream |
| CEP290-1393 | + | AGGUAAUGCCUGAACAAGUU (2200) | 20 | downstream |
| CEP290-1394 | − | ACGUGCUCUUUUCUAUAUA (2201) | 19 | downstream |
| CEP290-1395 | + | AUUAUCUAUUCCAUUCUUCACAC (2202) | 23 | downstream |
| CEP290-1396 | + | AUCUAUUCCAUUCUUCACAC (2203) | 20 | downstream |
| CEP290-1397 | + | AAGAGAGAAAUGGUUCCCUAUAUA (2204) | 24 | downstream |
| CEP290-1398 | + | AGAGAGAAAUGGUUCCCUAUAUA (2205) | 23 | downstream |
| CEP290-1399 | + | AGAGAAAUGGUUCCCUAUAUA (2206) | 21 | downstream |
| CEP290-1400 | + | AGAAAUGGUUCCCUAUAUA (2207) | 19 | downstream |
| CEP290-1401 | − | AGGAAAUUAUUGUUGCUUU (2208) | 19 | downstream |

TABLE 8E-continued

| gRNA Name | DNA Strand | Targeting Domain (SEQ ID NO) | Target Site Length | |
|---|---|---|---|---|
| CEP290-1402 | + | ACUGAGCAAAACAACUGGAAGA (2209) | 22 | downstream |
| CEP290-1403 | + | AGCAAAACAACUGGAAGA (2210) | 18 | downstream |
| CEP290-1404 | + | AUACAUAAGAAAGAACACUGUGGU (2211) | 24 | downstream |
| CEP290-1405 | + | ACAUAAGAAAGAACACUGUGGU (2212) | 22 | downstream |
| CEP290-1406 | + | AUAAGAAAGAACACUGUGGU (2213) | 20 | downstream |
| CEP290-1407 | + | AAGAAAGAACACUGUGGU (2214) | 18 | downstream |
| CEP290-1408 | − | AAGAAUGGAAUAGAUAAU (2215) | 18 | downstream |
| CEP290-1409 | + | AAGGAGGAUGUAAGACUGGAGA (2216) | 22 | downstream |
| CEP290-1410 | + | AGGAGGAUGUAAGACUGGAGA (2217) | 21 | downstream |
| CEP290-1411 | + | AGGAUGUAAGACUGGAGA (2218) | 18 | downstream |
| CEP290-1412 | − | AAAAACUUGAAAUUUGAUAGUAG (2219) | 23 | downstream |
| CEP290-1413 | − | AAAACUUGAAAUUUGAUAGUAG (2220) | 22 | downstream |
| CEP290-1414 | − | AAACUUGAAAUUUGAUAGUAG (2221) | 21 | downstream |
| CEP290-1415 | − | AACUUGAAAUUUGAUAGUAG (2222) | 20 | downstream |
| CEP290-1416 | − | ACUUGAAAUUUGAUAGUAG (2223) | 19 | downstream |
| CEP290-1417 | − | ACAUAUCUGUCUUCCUUA (2224) | 18 | downstream |
| CEP290-1418 | + | AUUAAAAAAGUAUGCUU (2225) | 18 | downstream |
| CEP290-1419 | + | AUAUCAAAAGACUUAUAUUCCAUU (2226) | 24 | downstream |
| CEP290-1420 | + | AUCAAAAGACUUAUAUUCCAUU (2227) | 22 | downstream |
| CEP290-1421 | + | AAAAGACUUAUAUUCCAUU (2228) | 19 | downstream |
| CEP290-1422 | + | AAAGACUUAUAUUCCAUU (2229) | 18 | downstream |
| CEP290-1423 | − | AAAAUCAGAUUUCAUGUGUGAAGA (2230) | 24 | downstream |
| CEP290-1424 | − | AAAUCAGAUUUCAUGUGUGAAGA (2231) | 23 | downstream |
| CEP290-1425 | − | AAUCAGAUUUCAUGUGUGAAGA (2232) | 22 | downstream |
| CEP290-1426 | − | AUCAGAUUUCAUGUGUGAAGA (2233) | 21 | downstream |
| CEP290-1427 | − | AGAUUUCAUGUGUGAAGA (2234) | 18 | downstream |
| CEP290-1428 | − | AAUGGAAUAUAAGUCUUUUGAUAU (2235) | 24 | downstream |
| CEP290-1429 | − | AUGGAAUAUAAGUCUUUUGAUAU (2236) | 23 | downstream |
| CEP290-1430 | − | AAUAUAAGUCUUUUGAUAU (2237) | 19 | downstream |
| CEP290-1431 | − | AUAUAAGUCUUUUGAUAU (2238) | 18 | downstream |
| CEP290-1432 | − | AAGAAUGGAAUAGAUAAUA (2239) | 19 | downstream |
| CEP290-1433 | − | AGAAUGGAAUAGAUAAUA (2240) | 18 | downstream |

TABLE 8E-continued

| gRNA Name | DNA Strand | Targeting Domain (SEQ ID NO) | Target Site Length | |
|---|---|---|---|---|
| CEP290-1434 | − | AAAACUGGAUGGGUAAUAAAGCAA (2241) | 24 | downstream |
| CEP290-1435 | − | AAACUGGAUGGGUAAUAAAGCAA (2242) | 23 | downstream |
| CEP290-1436 | − | AACUGGAUGGGUAAUAAAGCAA (2243) | 22 | downstream |
| CEP290-1437 | − | ACUGGAUGGGUAAUAAAGCAA (2244) | 21 | downstream |
| CEP290-1438 | + | AUAGAAAUUCACUGAGCAAAACAA (2245) | 24 | downstream |
| CEP290-1439 | + | AGAAAUUCACUGAGCAAAACAA (2246) | 22 | downstream |
| CEP290-1440 | + | AAAUUCACUGAGCAAAACAA (2247) | 20 | downstream |
| CEP290-1441 | + | AAUUCACUGAGCAAAACAA (2248) | 19 | downstream |
| CEP290-1442 | + | AUUCACUGAGCAAAACAA (2249) | 18 | downstream |
| CEP290-1443 | + | AGGAUGUAAGACUGGAGAUAGAGA (2250) | 24 | downstream |
| CEP290-1444 | + | AUGUAAGACUGGAGAUAGAGA (2251) | 21 | downstream |
| CEP290-1445 | − | AAAUUUGAUAGUAGAAGAAAA (2252) | 21 | downstream |
| CEP290-1446 | − | AAUUUGAUAGUAGAAGAAAA (2253) | 20 | downstream |
| CEP290-1447 | − | AUUUGAUAGUAGAAGAAAA (2254) | 19 | downstream |
| CEP290-1448 | + | AAAAUAAAACUAAGACACUGCCAA (2255) | 24 | downstream |
| CEP290-1449 | + | AAAUAAAACUAAGACACUGCCAA (2256) | 23 | downstream |
| CEP290-1450 | + | AAUAAAACUAAGACACUGCCAA (2257) | 22 | downstream |
| CEP290-1451 | + | AUAAAACUAAGACACUGCCAA (2258) | 21 | downstream |
| CEP290-1452 | + | AAAACUAAGACACUGCCAA (2259) | 19 | downstream |
| CEP290-1453 | + | AAACUAAGACACUGCCAA (2260) | 18 | downstream |
| CEP290-1454 | − | AAUAAAGCAAAAGAAAAC (2261) | 19 | downstream |
| CEP290-1455 | − | AUAAAGCAAAAGAAAAC (2262) | 18 | downstream |
| CEP290-1456 | − | AUUCUUUUUUGUUGUUUUUUUU (2263) | 24 | downstream |
| CEP290-1457 | + | ACUCCAGCCUGGGCAACACA (2264) | 20 | downstream |
| CEP290-1458 | − | CUUACCUCAUGUCAUCUAGAGC (2265) | 22 | downstream |
| CEP290-1459 | − | CCUCAUGUCAUCUAGAGC (2266) | 18 | downstream |
| CEP290-1460 | + | CAGUUUUUAAGGCGGGGAGUCAC (2267) | 23 | downstream |
| CEP290-1461 | − | CACAGAGUUCAAGCUAAUAC (2268) | 20 | downstream |
| CEP290-1462 | − | CAGAGUUCAAGCUAAUAC (2269) | 18 | downstream |
| CEP290-1463 | + | CUUGAACUCUGUGCCAAAC (2270) | 19 | downstream |
| CEP290-1464 | − | CAUGUGGUGUCAAAUAUGGUGCU (2271) | 23 | downstream |
| CEP290-1465 | − | CAUGUGGUGUCAAAUAUGGUGCUU (2272) | 24 | downstream |

TABLE 8E-continued

| gRNA Name | DNA Strand | Targeting Domain (SEQ ID NO) | Target Site Length | |
|---|---|---|---|---|
| CEP290-1466 | + | CUCUAGAUGACAUGAGGUAAGU (2273) | 22 | downstream |
| CEP290-1467 | + | CUAGAUGACAUGAGGUAAGU (2274) | 20 | downstream |
| CEP290-1468 | - | CUAAUACAUGAGAGUGAUUAGUGG (2275) | 24 | downstream |
| CEP290-1469 | - | CAUGAGAGUGAUUAGUGG (2276) | 18 | downstream |
| CEP290-509 | + | CACUGCCAAUAGGGAUAGGU (613) | 20 | downstream |
| CEP290-511 | + | CUGCCAAUAGGGAUAGGU (2277) | 18 | downstream |
| CEP290-1470 | + | CCAAACAGGAGAUACUCAACACA (2278) | 23 | downstream |
| CEP290-1471 | + | CAAACAGGAGAUACUCAACACA (2279) | 22 | downstream |
| CEP290-1472 | + | CAGGAGAUACUCAACACA (2280) | 18 | downstream |
| CEP290-1473 | + | CACGUACAAAAGAACAUACAU (2281) | 21 | downstream |
| CEP290-1474 | + | CGUACAAAAGAACAUACAU (2282) | 19 | downstream |
| CEP290-1475 | + | CAGUAAGGAGGAUGUAAGAC (2283) | 20 | downstream |
| CEP290-1476 | + | CUUUUGACAGUUUUUAAGG (2284) | 19 | downstream |
| CEP290-1477 | - | CGUGCUCUUUUCUAUAUAU (2285) | 19 | downstream |
| CEP290-1478 | + | CACUGAGCAAAACAACUGG (2286) | 19 | downstream |
| CEP290-1479 | + | CCUGAACAAGUUUUGAAACAGGAA (2287) | 24 | downstream |
| CEP290-1480 | + | CUGAACAAGUUUUGAAACAGGAA (2288) | 23 | downstream |
| CEP290-1481 | + | CAAGUUUUGAAACAGGAA (2289) | 18 | downstream |
| CEP290-1482 | + | CCUGAACAAGUUUUGAAA (2290) | 18 | downstream |
| CEP290-1483 | + | CACUGAGCAAAACAACUGGAA (2291) | 21 | downstream |
| CEP290-1484 | + | CUGAGCAAAACAACUGGAA (2292) | 19 | downstream |
| CEP290-1485 | - | CGUGCUCUUUUCUAUAUA (2293) | 18 | downstream |
| CEP290-1486 | + | CUAUUCCAUUCUUCACAC (2294) | 18 | downstream |
| CEP290-1487 | - | CUUAGGAAAUUAUUGUUGCUUU (2295) | 22 | downstream |
| CEP290-1488 | - | CUUUUUGAGAGGUAAAGGUUC (2296) | 21 | downstream |
| CEP290-1489 | + | CACUGAGCAAAACAACUGGAAGA (2297) | 23 | downstream |
| CEP290-1490 | + | CUGAGCAAAACAACUGGAAGA (2298) | 21 | downstream |
| CEP290-1491 | + | CAUAAGAAAGAACACUGUGGU (2299) | 21 | downstream |
| CEP290-1492 | - | CUUGAAAUUUGAUAGUAG (2300) | 18 | downstream |
| CEP290-1493 | + | CCAUUAAAAAAAGUAUGCUU (2301) | 20 | downstream |
| CEP290-1494 | + | CAUUAAAAAAAGUAUGCUU (2302) | 19 | downstream |
| CEP290-1495 | + | CAAAAGACUUAUAUUCCAUU (2303) | 20 | downstream |
| CEP290-1496 | - | CAGAUUUCAUGUGUGAAGA (2304) | 19 | downstream |
| CEP290-1497 | - | CUGGAUGGGUAAUAAAGCAA (2305) | 20 | downstream |
| CEP290-1498 | - | CUUAAGCAUACUUUUUUUA (2306) | 19 | downstream |

TABLE 8E-continued

| gRNA Name | DNA Strand | Targeting Domain (SEQ ID NO) | Target Site Length | |
|---|---|---|---|---|
| CEP290-1499 | − | CUUUUUUUGUUGUUUUUUUUU (2307) | 21 | downstream |
| CEP290-1500 | + | CUGCACUCCAGCCUGGGCAACACA (2308) | 24 | downstream |
| CEP290-1501 | + | CACUCCAGCCUGGGCAACACA (2309) | 21 | downstream |
| CEP290-1502 | + | CUCCAGCCUGGGCAACACA (2310) | 19 | downstream |
| CEP290-1503 | + | GUUUUUAAGGCGGGGAGUCAC (2311) | 21 | downstream |
| CEP290-230 | − | GGCACAGAGUUCAAGCUAAUAC (2312) | 22 | downstream |
| CEP290-1504 | − | GCACAGAGUUCAAGCUAAUAC (2313) | 21 | downstream |
| CEP290-1505 | + | GCUUGAACUCUGUGCCAAAC (461) | 20 | downstream |
| CEP290-139 | − | GCAUGUGGUGUCAAAUAUGGUGCU (2314) | 24 | downstream |
| CEP290-1506 | − | GUGGUGUCAAAUAUGGUGCU (2315) | 20 | downstream |
| CEP290-1507 | − | GGUGUCAAAUAUGGUGCU (2316) | 18 | downstream |
| CEP290-1508 | − | GUGGUGUCAAAUAUGGUGCUU (2317) | 21 | downstream |
| CEP290-1509 | − | GGUGUCAAAUAUGGUGCUU (2318) | 19 | downstream |
| CEP290-1510 | − | GUGUCAAAUAUGGUGCUU (2319) | 18 | downstream |
| CEP290-1511 | + | GCUCUAGAUGACAUGAGGUAAGU (2320) | 23 | downstream |
| CEP290-11 | + | GACACUGCCAAUAGGGAUAGGU (2321) | 22 | downstream |
| CEP290-1512 | − | GGUUCAUGAGACUAGAGGUC (2322) | 20 | downstream |
| CEP290-1513 | − | GUUCAUGAGACUAGAGGUC (2323) | 19 | downstream |
| CEP290-1514 | + | GCCAAACAGGAGAUACUCAACACA (2324) | 24 | downstream |
| CEP290-1515 | + | GAGCACGUACAAAAGAACAUACAU (2325) | 24 | downstream |
| CEP290-1516 | + | GCACGUACAAAAGAACAUACAU (2326) | 22 | downstream |
| CEP290-1517 | + | GUACAAAAGAACAUACAU (2327) | 18 | downstream |
| CEP290-1518 | + | GUGGCAGUAAGGAGGAUGUAAGAC (2328) | 24 | downstream |
| CEP290-1519 | + | GGCAGUAAGGAGGAUGUAAGAC (2329) | 22 | downstream |
| CEP290-1520 | + | GCAGUAAGGAGGAUGUAAGAC (2330) | 21 | downstream |
| CEP290-1521 | + | GUAAGGAGGAUGUAAGAC (2331) | 18 | downstream |
| CEP290-1522 | + | GGUAGCUUUUGACAGUUUUUAAGG (2332) | 24 | downstream |
| CEP290-1523 | + | GUAGCUUUUGACAGUUUUUAAGG (2333) | 23 | downstream |
| CEP290-1524 | + | GCUUUUGACAGUUUUUAAGG (SEQ ID NO: 482) | 20 | downstream |
| CEP290-1525 | − | GUACGUGCUCUUUUCUAUAUAU (2334) | 22 | downstream |

TABLE 8E-continued

| gRNA Name | DNA Strand | Targeting Domain (SEQ ID NO) | Target Site Length | |
|---|---|---|---|---|
| CEP290-1526 | − | GUGCUCUUUUCUAUAUAU (2335) | 18 | downstream |
| CEP290-1527 | + | GAACAAGUUUUGAAACAGGAA (2336) | 21 | downstream |
| CEP290-1528 | + | GUAAUGCCUGAACAAGUUUUGAAA (2337) | 24 | downstream |
| CEP290-1529 | + | GCCUGAACAAGUUUUGAAA (2338) | 19 | downstream |
| CEP290-1530 | + | GGUAAUGCCUGAACAAGUU (2339) | 19 | downstream |
| CEP290-1531 | + | GUAAUGCCUGAACAAGUU (2340) | 18 | downstream |
| CEP290-1532 | − | GUACGUGCUCUUUUCUAUAUA (2341) | 21 | downstream |
| CEP290-1533 | + | GAGAGAAAUGGUUCCCUAUAUA (2342) | 22 | downstream |
| CEP290-1534 | + | GAGAAAUGGUUCCCUAUAUA (2343) | 20 | downstream |
| CEP290-1535 | + | GAAAUGGUUCCCUAUAUA (2344) | 18 | downstream |
| CEP290-1536 | − | GCUUAGGAAAUUAUUGUUGCUUU (2345) | 23 | downstream |
| CEP290-1537 | − | GGAAAUUAUUGUUGCUUU (2346) | 18 | downstream |
| CEP290-1538 | − | GCUUUUUGAGAGGUAAAGGUUC (2347) | 22 | downstream |
| CEP290-1539 | + | GAGCAAAACAACUGGAAGA (2348) | 19 | downstream |
| CEP290-1540 | − | GUGUGAAGAAUGGAAUAGAUAAU (2349) | 23 | downstream |
| CEP290-1541 | − | GUGAAGAAUGGAAUAGAUAAU (2350) | 21 | downstream |
| CEP290-1542 | − | GAAGAAUGGAAUAGAUAAU (2351) | 19 | downstream |
| CEP290-1543 | + | GUAAGGAGGAUGUAAGACUGGAGA (2352) | 24 | downstream |
| CEP290-1544 | + | GGAGGAUGUAAGACUGGAGA (2353) | 20 | downstream |
| CEP290-1545 | + | GAGGAUGUAAGACUGGAGA (2354) | 19 | downstream |
| CEP290-1546 | − | GAAAAACUUGAAAUUUGAUAGUAG (2355) | 24 | downstream |
| CEP290-1547 | − | GUGUUUACAUAUCUGUCUUCCUUA (2356) | 24 | downstream |
| CEP290-1548 | − | GUUUACAUAUCUGUCUUCCUUA (2357) | 22 | downstream |
| CEP290-1549 | + | GUUCCAUUAAAAAAAGUAUGCUU (2358) | 23 | downstream |
| CEP290-1550 | − | GGAAUAUAAGUCUUUUGAUAU (2359) | 21 | downstream |
| CEP290-1551 | − | GAAUAUAAGUCUUUUGAUAU (2360) | 20 | downstream |
| CEP290-1552 | − | GUGUGAAGAAUGGAAUAGAUAAUA (2361) | 24 | downstream |
| CEP290-1553 | − | GUGAAGAAUGGAAUAGAUAAUA (2362) | 22 | downstream |
| CEP290-1554 | − | GAAGAAUGGAAUAGAUAAUA (467) | 20 | downstream |
| CEP290-1555 | − | GGAUGGGUAAUAAAGCAA (2363) | 18 | downstream |
| CEP290-1556 | + | GAAAUUCACUGAGCAAAACAA (2364) | 21 | downstream |
| CEP290-1557 | + | GGAUGUAAGACUGGAGAUAGAGA (2365) | 23 | downstream |

TABLE 8E-continued

| gRNA Name | DNA Strand | Targeting Domain (SEQ ID NO) | Target Site Length | |
|---|---|---|---|---|
| CEP290-1558 | + | GAUGUAAGACUGGAGAUAGAGA (2366) | 22 | downstream |
| CEP290-1559 | + | GUAAGACUGGAGAUAGAGA (2367) | 19 | downstream |
| CEP290-1560 | − | GAAAUUUGAUAGUAGAAGAAAA (2368) | 22 | downstream |
| CEP290-1561 | − | GGGUAAUAAAGCAAAAGAAAAAC (2369) | 23 | downstream |
| CEP290-1562 | − | GGUAAUAAAGCAAAAGAAAAAC (2370) | 22 | downstream |
| CEP290-1563 | − | GUAAUAAAGCAAAAGAAAAAC (2371) | 21 | downstream |
| CEP290-1564 | + | GCACUCCAGCCUGGGCAACACA (2372) | 22 | downstream |
| CEP290-1565 | − | UACUUACCUCAUGUCAUCUAGAGC (2373) | 24 | downstream |
| CEP290-1566 | − | UUACCUCAUGUCAUCUAGAGC (2374) | 21 | downstream |
| CEP290-1567 | − | UACCUCAUGUCAUCUAGAGC (2375) | 20 | downstream |
| CEP290-1568 | + | UUUUUAAGGCGGGGAGUCAC (2376) | 20 | downstream |
| CEP290-1569 | + | UUUUAAGGCGGGGAGUCAC (2377) | 19 | downstream |
| CEP290-1570 | + | UUUAAGGCGGGGAGUCAC (2378) | 18 | downstream |
| CEP290-1571 | − | UUGGCACAGAGUUCAAGCUAAUAC (2379) | 24 | downstream |
| CEP290-1572 | − | UGGCACAGAGUUCAAGCUAAUAC (2380) | 23 | downstream |
| CEP290-1573 | + | UUAGCUUGAACUCUGUGCCAAAC (2381) | 23 | downstream |
| CEP290-1574 | + | UAGCUUGAACUCUGUGCCAAAC (2382) | 22 | downstream |
| CEP290-1575 | + | UUGAACUCUGUGCCAAAC (2383) | 18 | downstream |
| CEP290-1576 | − | UGUGGUGUCAAAUAUGGUGCU (2384) | 21 | downstream |
| CEP290-1577 | − | UGGUGUCAAAUAUGGUGCU (2385) | 19 | downstream |
| CEP290-1578 | − | UGUGGUGUCAAAUAUGGUGCUU (2386) | 22 | downstream |
| CEP290-1579 | − | UGGUGUCAAAUAUGGUGCUU (2387) | 20 | downstream |
| CEP290-1580 | + | UGCUCUAGAUGACAUGAGGUAAGU (2388) | 24 | downstream |
| CEP290-1581 | + | UCUAGAUGACAUGAGGUAAGU (2389) | 21 | downstream |
| CEP290-1582 | + | UAGAUGACAUGAGGUAAGU (2390) | 19 | downstream |
| CEP290-1583 | − | UAAUACAUGAGAGUGAUUAGUGG (2391) | 23 | downstream |
| CEP290-1584 | − | UACAUGAGAGUGAUUAGUGG (628) | 20 | downstream |
| CEP290-1585 | − | UAAAGGUUCAUGAGACUAGAGGUC (2392) | 24 | downstream |
| CEP290-1586 | − | UUCAUGAGACUAGAGGUC (2393) | 18 | downstream |
| CEP290-1587 | + | UGGCAGUAAGGAGGAUGUAAGAC (2394) | 23 | downstream |

TABLE 8E-continued

| gRNA Name | DNA Strand | Targeting Domain (SEQ ID NO) | Target Site Length | |
|---|---|---|---|---|
| CEP290-1588 | + | UAGCUUUUGACAGUUUUUAAGG (2395) | 22 | downstream |
| CEP290-1589 | + | UUUUGACAGUUUUUAAGG (2396) | 18 | downstream |
| CEP290-1590 | − | UUGUACGUGCUCUUUUCUAUAUAU (2397) | 24 | downstream |
| CEP290-1591 | − | UGUACGUGCUCUUUUCUAUAUAU (2398) | 23 | downstream |
| CEP290-1592 | − | UACGUGCUCUUUUCUAUAUAU (2399) | 21 | downstream |
| CEP290-1593 | + | UUCACUGAGCAAAACAACUGG (2400) | 21 | downstream |
| CEP290-1594 | + | UCACUGAGCAAAACAACUGG (2401) | 20 | downstream |
| CEP290-1595 | + | UGAACAAGUUUUGAAACAGGAA (2402) | 22 | downstream |
| CEP290-1596 | + | UAAUGCCUGAACAAGUUUUGAAA (2403) | 23 | downstream |
| CEP290-1597 | + | UGCCUGAACAAGUUUUGAAA (2404) | 20 | downstream |
| CEP290-1598 | + | UUCACUGAGCAAAACAACUGGAA (2405) | 23 | downstream |
| CEP290-1599 | + | UCACUGAGCAAAACAACUGGAA (2406) | 22 | downstream |
| CEP290-1600 | + | UGAGCAAAACAACUGGAA (2407) | 18 | downstream |
| CEP290-1601 | − | UUUGUACGUGCUCUUUUCUAUAUA (2408) | 24 | downstream |
| CEP290-1602 | − | UUGUACGUGCUCUUUUCUAUAUA (2409) | 23 | downstream |
| CEP290-1603 | − | UGUACGUGCUCUUUUCUAUAUA (2410) | 22 | downstream |
| CEP290-1604 | − | UACGUGCUCUUUUCUAUAUA (2411) | 20 | downstream |
| CEP290-1605 | + | UAUUAUCUAUUCCAUUCUUCACAC (2412) | 24 | downstream |
| CEP290-1606 | + | UUAUCUAUUCCAUUCUUCACAC (2413) | 22 | downstream |
| CEP290-1607 | + | UAUCUAUUCCAUUCUUCACAC (2414) | 21 | downstream |
| CEP290-1608 | + | UCUAUUCCAUUCUUCACAC (2415) | 19 | downstream |
| CEP290-1609 | − | UGCUUAGGAAAUUAUUGUUGCUUU (2416) | 24 | downstream |
| CEP290-1610 | − | UUAGGAAAUUAUUGUUGCUUU (2417) | 21 | downstream |
| CEP290-1611 | − | UAGGAAAUUAUUGUUGCUUU (2418) | 20 | downstream |
| CEP290-1612 | − | UUGCUUUUGAGAGGUAAAGGUUC (2419) | 24 | downstream |
| CEP290-1613 | − | UGCUUUUGAGAGGUAAAGGUUC (2420) | 23 | downstream |
| CEP290-1614 | − | UUUUUGAGAGGUAAAGGUUC (2421) | 20 | downstream |
| CEP290-1615 | − | UUUUGAGAGGUAAAGGUUC (2422) | 19 | downstream |
| CEP290-1616 | − | UUUGAGAGGUAAAGGUUC (2423) | 18 | downstream |
| CEP290-1617 | + | UCACUGAGCAAAACAACUGGAAGA (2424) | 24 | downstream |

TABLE 8E-continued

| gRNA Name | DNA Strand | Targeting Domain (SEQ ID NO) | Target Site Length | |
|---|---|---|---|---|
| CEP290-1618 | + | UGAGCAAACAACUGGAAGA (2425) | 20 | downstream |
| CEP290-1619 | + | UACAUAAGAAAGAACACUGUGGU (2426) | 23 | downstream |
| CEP290-1620 | + | UAAGAAAGAACACUGUGGU (2427) | 19 | downstream |
| CEP290-1621 | - | UGUGUGAAGAAUGGAAUAGAUAAU (2428) | 24 | downstream |
| CEP290-1622 | - | UGUGAAGAAUGGAAUAGAUAAU (2429) | 22 | downstream |
| CEP290-1623 | - | UGAAGAAUGGAAUAGAUAAU (2430) | 20 | downstream |
| CEP290-1624 | + | UAAGGAGGAUGUAAGACUGGAGA (2431) | 23 | downstream |
| CEP290-1625 | - | UGUUUACAUAUCUGUCUUCCUUA (2432) | 23 | downstream |
| CEP290-1626 | - | UUUACAUAUCUGUCUUCCUUA (2433) | 21 | downstream |
| CEP290-1627 | - | UUACAUAUCUGUCUUCCUUA (2434) | 20 | downstream |
| CEP290-1628 | - | UACAUAUCUGUCUUCCUUA (2435) | 19 | downstream |
| CEP290-1629 | + | UGUUCCAUUAAAAAAAGUAUGCUU (2436) | 24 | downstream |
| CEP290-1630 | + | UUCCAUUAAAAAAAGUAUGCUU (2437) | 22 | downstream |
| CEP290-1631 | + | UCCAUUAAAAAAAGUAUGCUU (2438) | 21 | downstream |
| CEP290-1632 | + | UAUCAAAAGACUUAUAUUCCAUU (2439) | 23 | downstream |
| CEP290-1633 | + | UCAAAAGACUUAUAUUCCAUU (2440) | 21 | downstream |
| CEP290-1634 | - | UCAGAUUUCAUGUGUGAAGA (2441) | 20 | downstream |
| CEP290-1635 | - | UGGAAUAUAAGUCUUUUGAUAU (2442) | 22 | downstream |
| CEP290-1636 | - | UGUGAAGAAUGGAAUAGAUAAUA (2443) | 23 | downstream |
| CEP290-1637 | - | UGAAGAAUGGAAUAGAUAAUA (2444) | 21 | downstream |
| CEP290-1638 | - | UGGAUGGGUAAUAAAGCAA (2445) | 19 | downstream |
| CEP290-1639 | + | UAGAAAUUCACUGAGCAAACAA (2446) | 23 | downstream |
| CEP290-1640 | + | UGUAAGACUGGAGAUAGAGA (2447) | 20 | downstream |
| CEP290-1641 | + | UAAGACUGGAGAUAGAGA (2448) | 18 | downstream |
| CEP290-1642 | - | UUGAAAUUUGAUAGUAGAAGAAAA (2449) | 24 | downstream |
| CEP290-1643 | - | UGAAAUUUGAUAGUAGAAGAAAA (2450) | 23 | downstream |
| CEP290-1644 | - | UUUGAUAGUAGAAGAAAA (2451) | 18 | downstream |
| CEP290-1645 | + | UAAAACUAAGACACUGCCAA (2452) | 20 | downstream |
| CEP290-1646 | - | UUUUUCUUAAGCAUACUUUUUUA (2453) | 24 | downstream |
| CEP290-1647 | - | UUUUCUUAAGCAUACUUUUUUA (2454) | 23 | downstream |

TABLE 8E-continued

| gRNA Name | DNA Strand | Targeting Domain (SEQ ID NO) | Target Site Length | |
|---|---|---|---|---|
| CEP290-1648 | – | UUUCUUAAGCAUACUUUUUUA (2455) | 22 | downstream |
| CEP290-1649 | – | UUCUUAAGCAUACUUUUUUA (2456) | 21 | downstream |
| CEP290-1650 | – | UCUUAAGCAUACUUUUUUA (2457) | 20 | downstream |
| CEP290-1651 | – | UUAAGCAUACUUUUUUA (2458) | 18 | downstream |
| CEP290-1652 | – | UGGGUAAUAAAGCAAAAGAAAAAC (2459) | 24 | downstream |
| CEP290-1653 | – | UAAUAAAGCAAAAGAAAAAC (2460) | 20 | downstream |
| CEP290-1654 | – | UUCUUUUUUGUUGUUUUUUUU (2461) | 23 | downstream |
| CEP290-1655 | – | UCUUUUUUGUUGUUUUUUUU (2462) | 22 | downstream |
| CEP290-1656 | – | UUUUUUGUUGUUUUUUUU (2463) | 20 | downstream |
| CEP290-1657 | – | UUUUUGUUGUUUUUUUU (2464) | 19 | downstream |
| CEP290-1658 | – | UUUUUGUUGUUUUUUU (2465) | 18 | downstream |
| CEP290-1659 | + | UGCACUCCAGCCUGGGCAACACA (2466) | 23 | downstream |
| CEP290-1660 | + | UCCAGCCUGGGCAACACA (2467) | 18 | downstream |
| CEP290-1661 | + | AUUUUCGUGACCUCUAGUCUC (2468) | 21 | downstream |
| CEP290-1662 | + | ACUAAUCACUCUCAUGUAUUAGC (2469) | 23 | downstream |
| CEP290-1663 | + | AAUCACUCUCAUGUAUUAGC (2470) | 20 | downstream |
| CEP290-1664 | + | AUCACUCUCAUGUAUUAGC (2471) | 19 | downstream |
| CEP290-1665 | + | AGAUGACAUGAGGUAAGUA (2472) | 19 | downstream |
| CEP290-1666 | – | ACCUCAUGUCAUCUAGAGCAAGAG (2473) | 24 | downstream |
| CEP290-1667 | – | AUGUCAUCUAGAGCAAGAG (2474) | 19 | downstream |
| CEP290-1668 | – | AAUACAUGAGAGUGAUUAGUGGUG (2475) | 24 | downstream |
| CEP290-1669 | – | AUACAUGAGAGUGAUUAGUGGUG (2476) | 23 | downstream |
| CEP290-1670 | – | ACAUGAGAGUGAUUAGUGGUG (2477) | 21 | downstream |
| CEP290-1671 | – | AUGAGAGUGAUUAGUGGUG (2478) | 19 | downstream |
| CEP290-1672 | – | ACGUGCUCUUUUCUAUAUAUA (2479) | 21 | downstream |
| CEP290-1673 | + | ACAAAACCUAUGUAUAAGAUG (2480) | 21 | downstream |
| CEP290-1674 | + | AAAACCUAUGUAUAAGAUG (2481) | 19 | downstream |
| CEP290-1675 | + | AAACCUAUGUAUAAGAUG (2482) | 18 | downstream |
| CEP290-1676 | + | AUAUAUAGAAAAGAGCACGUACAA (2483) | 24 | downstream |
| CEP290-1677 | + | AUAUAGAAAAGAGCACGUACAA (2484) | 22 | downstream |
| CEP290-1678 | + | AUAGAAAAGAGCACGUACAA (2485) | 20 | downstream |
| CEP290-1679 | + | AGAAAAGAGCACGUACAA (2486) | 18 | downstream |

TABLE 8E-continued

| gRNA Name | DNA Strand | Targeting Domain (SEQ ID NO) | Target Site Length | |
|---|---|---|---|---|
| CEP290-1680 | + | AGAAAUGGUUCCCUAUAUAUAGAA (2487) | 24 | downstream |
| CEP290-1681 | + | AAAUGGUUCCCUAUAUAUAGAA (2488) | 22 | downstream |
| CEP290-1682 | + | AAUGGUUCCCUAUAUAUAGAA (2489) | 21 | downstream |
| CEP290-1683 | + | AUGGUUCCCUAUAUAUAGAA (2490) | 20 | downstream |
| CEP290-1684 | − | AUGGAAUAUAAGUCUUUUGAUAUA (2491) | 24 | downstream |
| CEP290-1685 | − | AAUAUAAGUCUUUUGAUAUA (2492) | 20 | downstream |
| CEP290-1686 | − | AUAUAAGUCUUUUGAUAUA (2493) | 19 | downstream |
| CEP290-1687 | + | ACG UACAAAAGAACAUACAUAAGA (2494) | 24 | downstream |
| CEP290-1688 | + | ACAAAAGAACAUACAUAAGA (2495) | 20 | downstream |
| CEP290-1689 | + | AAAAGAACAUACAUAAGA (2496) | 18 | downstream |
| CEP290-1690 | + | AAGAAAAAAAGGUAAUGC (2497) | 19 | downstream |
| CEP290-1691 | + | AGAAAAAAAGGUAAUGC (2498) | 18 | downstream |
| CEP290-1692 | + | AAACAGGAAUAGAAAUUCA (2499) | 19 | downstream |
| CEP290-1693 | + | AACAGGAAUAGAAAUUCA (2500) | 18 | downstream |
| CEP290-1694 | + | AAGAUCACUCCACUGCACUCCAGC (2501) | 24 | downstream |
| CEP290-1695 | + | AGAUCACUCCACUGCACUCCAGC (2502) | 23 | downstream |
| CEP290-1696 | + | AUCACUCCACUGCACUCCAGC (2503) | 21 | downstream |
| CEP290-1697 | + | ACUCCACUGCACUCCAGC (2504) | 18 | downstream |
| CEP290-1698 | − | CCCCUACUUACCUCAUGUCAUC (2505) | 22 | downstream |
| CEP290-1699 | − | CCCUACUUACCUCAUGUCAUC (2506) | 21 | downstream |
| CEP290-1700 | − | CCUACUUACCUCAUGUCAUC (2507) | 20 | downstream |
| CEP290-1701 | − | CUACUUACCUCAUGUCAUC (2508) | 19 | downstream |
| CEP290-1702 | + | CUGAUUUUCGUGACCUCUAGUCUC (2509) | 24 | downstream |
| CEP290-1703 | + | CACUAAUCACUCUCAUGUAUUAGC (2510) | 24 | downstream |
| CEP290-1704 | + | CUAAUCACUCUCAUGUAUUAGC (2511) | 22 | downstream |
| CEP290-1705 | + | CUCUAGAUGACAUGAGGUAAGUA (2512) | 23 | downstream |
| CEP290-1706 | + | CUAGAUGACAUGAGGUAAGUA (2513) | 21 | downstream |
| CEP290-1707 | − | CCUCAUGUCAUCUAGAGCAAGAG (2514) | 23 | downstream |
| CEP290-1708 | − | CUCAUGUCAUCUAGAGCAAGAG (2515) | 22 | downstream |
| CEP290-1709 | − | CAUGUCAUCUAGAGCAAGAG (2516) | 20 | downstream |
| CEP290-1710 | − | CAUGAGAGUGAUUAGUGGUG (2517) | 20 | downstream |
| CEP290-1711 | − | CGUGCUCUUUUCUAUAUAUA (2518) | 20 | downstream |

TABLE 8E-continued

| gRNA Name | DNA Strand | Targeting Domain (SEQ ID NO) | Target Site Length | |
|---|---|---|---|---|
| CEP290-1712 | + | CAAAACCUAUGUAUAAGAUG (2519) | 20 | downstream |
| CEP290-1713 | + | CGUACAAAAGAACAUACAUAAGA (2520) | 23 | downstream |
| CEP290-1714 | + | CAAAGAACAUACAUAAGA (2521) | 19 | downstream |
| CEP290-1715 | + | CUUAAGAAAAAAAAGGUAAUGC (2522) | 22 | downstream |
| CEP290-1716 | − | CUUAAGCAUACUUUUUUAA (2523) | 20 | downstream |
| CEP290-1717 | + | CACUCCACUGCACUCCAGC (2524) | 19 | downstream |
| CEP290-132 | − | GUCCCUACUUACCUCAUGUCAUC (2525) | 24 | downstream |
| CEP290-1718 | + | GAUUUUCGUGACCUCUAGUCUC (2526) | 22 | downstream |
| CEP290-1719 | + | GCUCUAGAUGACAUGAGGUAAGUA (2527) | 24 | downstream |
| CEP290-1720 | + | GAUGACAUGAGGUAAGUA (2528) | 18 | downstream |
| CEP290-1721 | − | GUACGUGCUCUUUUCUAUAUAUA (2529) | 23 | downstream |
| CEP290-1722 | − | GUGCUCUUUUCUAUAUAUA (2530) | 19 | downstream |
| CEP290-1723 | + | GUACAAAACCUAUGUAUAAGAUG (2531) | 23 | downstream |
| CEP290-1724 | + | GAAAUGGUUCCCUAUAUAUAGAA (2532) | 23 | downstream |
| CEP290-1725 | + | GGUUCCCUAUAUAUAGAA (2533) | 18 | downstream |
| CEP290-1726 | − | GGAAUAUAAGUCUUUUGAUAUA (2534) | 22 | downstream |
| CEP290-1727 | − | GAAUAUAAGUCUUUUGAUAUA (2535) | 21 | downstream |
| CEP290-1728 | + | GUACAAAAGAACAUACAUAAGA (2536) | 22 | downstream |
| CEP290-1729 | + | GCUUAAGAAAAAAAAGGUAAUGC (2537) | 23 | downstream |
| CEP290-1730 | + | GAAACAGGAAUAGAAAUUCA (2538) | 20 | downstream |
| CEP290-1731 | + | GAUCACUCCACUGCACUCCAGC (2539) | 22 | downstream |
| CEP290-1732 | − | UCCCCUACUUACCUCAUGUCAUC (2540) | 23 | downstream |
| CEP290-1733 | − | UACUUACCUCAUGUCAUC (2541) | 18 | downstream |
| CEP290-1734 | + | UGAUUUUCGUGACCUCUAGUCUC (2542) | 23 | downstream |
| CEP290-1735 | + | UUUUCGUGACCUCUAGUCUC (2543) | 20 | downstream |
| CEP290-1736 | + | UUUCGUGACCUCUAGUCUC (2544) | 19 | downstream |
| CEP290-1737 | + | UUCGUGACCUCUAGUCUC (2545) | 18 | downstream |
| CEP290-1738 | + | UAAUCACUCUCAUGUAUUAGC (2546) | 21 | downstream |
| CEP290-1739 | + | UCACUCUCAUGUAUUAGC (2547) | 18 | downstream |
| CEP290-1740 | + | UCUAGAUGACAUGAGGUAAGUA (2548) | 22 | downstream |
| CEP290-1741 | + | UAGAUGACAUGAGGUAAGUA (2549) | 20 | downstream |

TABLE 8E-continued

| gRNA Name | DNA Strand | Targeting Domain (SEQ ID NO) | Target Site Length | |
|---|---|---|---|---|
| CEP290-1742 | − | UCAUGUCAUCUAGAGCAAGAG (2550) | 21 | downstream |
| CEP290-1743 | − | UGUCAUCUAGAGCAAGAG (2551) | 18 | downstream |
| CEP290-1744 | − | UACAUGAGAGUGAUUAGUGGUG (2552) | 22 | downstream |
| CEP290-1745 | − | UGAGAGUGAUUAGUGGUG (2553) | 18 | downstream |
| CEP290-1746 | − | UGUACGUGCUCUUUUCUAUAUAUA (2554) | 24 | downstream |
| CEP290-1747 | − | UACGUGCUCUUUUCUAUAUAUA (2555) | 22 | downstream |
| CEP290-1748 | − | UGCUCUUUUCUAUAUAUA (2556) | 18 | downstream |
| CEP290-1749 | + | UGUACAAAACCUAUGUAUAAGAUG (2557) | 24 | downstream |
| CEP290-1750 | + | UACAAAACCUAUGUAUAAGAUG (2558) | 22 | downstream |
| CEP290-1751 | + | UAUAUAGAAAAGAGCACGUACAA (2559) | 23 | downstream |
| CEP290-1752 | + | UAUAGAAAAGAGCACGUACAA (2560) | 21 | downstream |
| CEP290-1753 | + | UAGAAAAGAGCACGUACAA (2561) | 19 | downstream |
| CEP290-1754 | + | UGGUUCCCUAUAUAUAGAA (2562) | 19 | downstream |
| CEP290-1755 | − | UGGAAUAUAAGUCUUUUGAUAUA (2563) | 23 | downstream |
| CEP290-1756 | − | UAUAAGUCUUUUGAUAUA (2564) | 18 | downstream |
| CEP290-1757 | + | UACAAAAGAACAUACAUAAGA (2565) | 21 | downstream |
| CEP290-1758 | + | UGCUUAAGAAAAAAAGGUAAUGC (2566) | 24 | downstream |
| CEP290-1759 | + | UUAAGAAAAAAAGGUAAUGC (2567) | 21 | downstream |
| CEP290-1760 | + | UAAGAAAAAAAGGUAAUGC (2568) | 20 | downstream |
| CEP290-1761 | + | UUUUGAAACAGGAAUAGAAAUUCA (2569) | 24 | downstream |
| CEP290-1762 | + | UUUGAAACAGGAAUAGAAAUUCA (2570) | 23 | downstream |
| CEP290-1763 | + | UUGAAACAGGAAUAGAAAUUCA (2571) | 22 | downstream |
| CEP290-1764 | + | UGAAACAGGAAUAGAAAUUCA (2572) | 21 | downstream |
| CEP290-1765 | − | UUUUCUUAAGCAUACUUUUUUAA (2573) | 24 | downstream |
| CEP290-1766 | − | UUUCUUAAGCAUACUUUUUUAA (2574) | 23 | downstream |
| CEP290-1767 | − | UUCUUAAGCAUACUUUUUUAA (2575) | 22 | downstream |
| CEP290-1768 | − | UCUUAAGCAUACUUUUUUAA (2576) | 21 | downstream |
| CEP290-1769 | − | UUAAGCAUACUUUUUUAA (2577) | 19 | downstream |
| CEP290-1770 | − | UAAGCAUACUUUUUUAA (2578) | 18 | downstream |
| CEP290-1771 | + | UCACUCCACUGCACUCCAGC (2579) | 20 | downstream |
| CEP290-1772 | + | AGUUUUUAAGGCGGGGAGUCACA (2580) | 23 | downstream |

TABLE 8E-continued

| gRNA Name | DNA Strand | Targeting Domain (SEQ ID NO) | Target Site Length | |
|---|---|---|---|---|
| CEP290-1773 | − | AAACUGUCAAAAGCUACCGGUUAC (2581) | 24 | downstream |
| CEP290-1774 | − | AACUGUCAAAAGCUACCGGUUAC (2582) | 23 | downstream |
| CEP290-252 | − | ACUGUCAAAAGCUACCGGUUAC (2583) | 22 | downstream |
| CEP290-1775 | + | AGUUCAUCUCUUGCUCUAGAUGAC (2584) | 24 | downstream |
| CEP290-1776 | + | AUCUCUUGCUCUAGAUGAC (2585) | 19 | downstream |
| CEP290-1777 | − | ACGAAAAUCAGAUUUCAUGU (2586) | 20 | downstream |
| CEP290-1778 | − | AAUACAUGAGAGUGAUUAGUG (2587) | 21 | downstream |
| CEP290-1779 | − | AUACAUGAGAGUGAUUAGUG (2588) | 20 | downstream |
| CEP290-1780 | − | ACAUGAGAGUGAUUAGUG (2589) | 18 | downstream |
| CEP290-1781 | + | AUUAGCUUGAACUCUGUGCCAAA (2590) | 23 | downstream |
| CEP290-1782 | + | AGCUUGAACUCUGUGCCAAA (2591) | 20 | downstream |
| CEP290-1783 | − | AUGUAGAUUGAGGUAGAAUCAAG (2592) | 23 | downstream |
| CEP290-1784 | − | AGAUUGAGGUAGAAUCAAG (2593) | 19 | downstream |
| CEP290-1785 | + | AUAAGAUGCAGAACUAGUGUAGA (2594) | 23 | downstream |
| CEP290-1786 | + | AAGAUGCAGAACUAGUGUAGA (2595) | 21 | downstream |
| CEP290-1787 | + | AGAUGCAGAACUAGUGUAGA (2596) | 20 | downstream |
| CEP290-1788 | + | AUGCAGAACUAGUGUAGA (2597) | 18 | downstream |
| CEP290-1789 | − | AUAGAUGUAGAUUGAGGUAGAAUC (2598) | 24 | downstream |
| CEP290-1790 | − | AGAUGUAGAUUGAGGUAGAAUC (2599) | 22 | downstream |
| CEP290-1791 | − | AUGUAGAUUGAGGUAGAAUC (2600) | 20 | downstream |
| CEP290-1792 | + | AGAAUGAUCAUUCUUGUGGCAGUA (2601) | 24 | downstream |
| CEP290-1793 | + | AAUGAUCAUUCUUGUGGCAGUA (2602) | 22 | downstream |
| CEP290-1794 | + | AUGAUCAUUCUUGUGGCAGUA (2603) | 21 | downstream |
| CEP290-1795 | + | AUCAUUCUUGUGGCAGUA (2604) | 18 | downstream |
| CEP290-1796 | + | AGAAUGAUCAUUCUUGUGGCAGU (2605) | 23 | downstream |
| CEP290-1797 | + | AAUGAUCAUUCUUGUGGCAGU (2606) | 21 | downstream |
| CEP290-1798 | + | AUGAUCAUUCUUGUGGCAGU (2607) | 20 | downstream |
| CEP290-1799 | − | AGAGGUAAAGGUUCAUGAGAC (2608) | 21 | downstream |
| CEP290-1800 | − | AGGUAAAGGUUCAUGAGAC (2609) | 19 | downstream |
| CEP290-1801 | + | AGCUUUUGACAGUUUUUAAG (2610) | 20 | downstream |
| CEP290-1802 | + | AGCUUUUGACAGUUUUUAAGGC (2611) | 22 | downstream |
| CEP290-1803 | + | AGAAAUUCACUGAGCAAACAAC (2612) | 23 | downstream |

TABLE 8E-continued

| gRNA Name | DNA Strand | Targeting Domain (SEQ ID NO) | Target Site Length | |
|---|---|---|---|---|
| CEP290-1804 | + | AAAUUCACUGAGCAAAACAAC (2613) | 21 | downstream |
| CEP290-1805 | + | AAUUCACUGAGCAAAACAAC (2614) | 20 | downstream |
| CEP290-1806 | + | AUUCACUGAGCAAAACAAC (2615) | 19 | downstream |
| CEP290-1807 | + | AGUAAGGAGGAUGUAAGA (2616) | 18 | downstream |
| CEP290-1808 | + | AUCAAAAGACUUAUAUUCCAUUA (2617) | 23 | downstream |
| CEP290-1809 | + | AAAAGACUUAUAUUCCAUUA (2618) | 20 | downstream |
| CEP290-1810 | + | AAAGACUUAUAUUCCAUUA (2619) | 19 | downstream |
| CEP290-1811 | + | AAGACUUAUAUUCCAUUA (2620) | 18 | downstream |
| CEP290-1812 | − | AGGAAAUUAUUGUUGCUUUUU (2621) | 21 | downstream |
| CEP290-1813 | − | AAAUUAUUGUUGCUUUUU (2622) | 18 | downstream |
| CEP290-1814 | − | AAAGAAAAACUUGAAAUUUGAUAG (2623) | 24 | downstream |
| CEP290-1815 | − | AAGAAAAACUUGAAAUUUGAUAG (2624) | 23 | downstream |
| CEP290-1816 | − | AGAAAAACUUGAAAUUUGAUAG (2625) | 22 | downstream |
| CEP290-1817 | − | AAAAACUUGAAAUUUGAUAG (2626) | 20 | downstream |
| CEP290-1818 | − | AAAACUUGAAAUUUGAUAG (2627) | 19 | downstream |
| CEP290-1819 | − | AAACUUGAAAUUUGAUAG (2628) | 18 | downstream |
| CEP290-1820 | − | AAGAAAAAGAAAUAGAUGUAGA (2629) | 23 | downstream |
| CEP290-1821 | − | AGAAAAAGAAAUAGAUGUAGA (2630) | 22 | downstream |
| CEP290-1822 | − | AAAAAGAAAUAGAUGUAGA (2631) | 20 | downstream |
| CEP290-1823 | − | AAAAGAAAUAGAUGUAGA (2632) | 19 | downstream |
| CEP290-1824 | − | AAAGAAAUAGAUGUAGA (2633) | 18 | downstream |
| CEP290-1825 | − | AGAGUCUCACUGUGUUGCCCAGG (2634) | 23 | downstream |
| CEP290-1826 | − | AGUCUCACUGUGUUGCCCAGG (2635) | 21 | downstream |
| CEP290-1827 | + | CAGUUUUUAAGGCGGGGAGUCACA (2636) | 24 | downstream |
| CEP290-1828 | − | CUGUCAAAAGCUACCGGUUAC (2637) | 21 | downstream |
| CEP290-1829 | + | CAUCUCUUGCUCUAGAUGAC (2638) | 20 | downstream |
| CEP290-1830 | − | CACGAAAAUCAGAUUUCAUGU (2639) | 21 | downstream |
| CEP290-1831 | − | CGAAAAUCAGAUUUCAUGU (2640) | 19 | downstream |
| CEP290-1832 | − | CUAAUACAUGAGAGUGAUUAGUG (2641) | 23 | downstream |
| CEP290-1833 | + | CUUGAACUCUGUGCCAAA (2642) | 18 | downstream |
| CEP290-1834 | + | CUCUAGAUGACAUGAGGUAAG (2643) | 21 | downstream |
| CEP290-1835 | + | CUAGAUGACAUGAGGUAAG (2644) | 19 | downstream |
| CEP290-1836 | + | CGGUAGCUUUUGACAGUUUUUAAG (2645) | 24 | downstream |

TABLE 8E-continued

| gRNA Name | DNA Strand | Targeting Domain (SEQ ID NO) | Target Site Length | |
|---|---|---|---|---|
| CEP290-1837 | + | CUUUUGACAGUUUUUAAG (2646) | 18 | downstream |
| CEP290-1838 | + | CUUUUGACAGUUUUUAAGGC (2647) | 20 | downstream |
| CEP290-1839 | + | CAGUAAGGAGGAUGUAAGA (2648) | 19 | downstream |
| CEP290-1840 | + | CAAAAGACUUAUAUUCCAUUA (2649) | 21 | downstream |
| CEP290-1841 | − | CUUAGGAAAUUAUUGUUGCUUUUU (2650) | 24 | downstream |
| CEP290-1842 | − | CUGUGUUGCCCAGGCUGGAGUGCA (2651) | 24 | downstream |
| CEP290-1843 | − | CAGAGUCUCACUGUGUUGCCCAGG (2652) | 24 | downstream |
| CEP290-1844 | − | CUCACUGUGUUGCCCAGG (2653) | 18 | downstream |
| CEP290-1845 | + | GUUUUUAAGGCGGGGAGUCACA (2654) | 22 | downstream |
| CEP290-1846 | − | GUCAAAAGCUACCGGUUAC (2655) | 19 | downstream |
| CEP290-1847 | + | GUUCAUCUCUUGCUCUAGAUGAC (2656) | 23 | downstream |
| CEP290-1848 | − | GGUCACGAAAAUCAGAUUUCAUGU (2657) | 24 | downstream |
| CEP290-1849 | − | GUCACGAAAAUCAGAUUUCAUGU (2658) | 23 | downstream |
| CEP290-1850 | − | GAAAAUCAGAUUUCAUGU (2659) | 18 | downstream |
| CEP290-1851 | − | GCUAAUACAUGAGAGUGAUUAGUG (2660) | 24 | downstream |
| CEP290-1852 | + | GCUUGAACUCUGUGCCAAA (2661) | 19 | downstream |
| CEP290-1853 | + | GCUCUAGAUGACAUGAGGUAAG (2662) | 22 | downstream |
| CEP290-1854 | − | GAUGUAGAUUGAGGUAGAAUCAAG (2663) | 24 | downstream |
| CEP290-1855 | − | GUAGAUUGAGGUAGAAUCAAG (2664) | 21 | downstream |
| CEP290-1856 | − | GAUUGAGGUAGAAUCAAG (2665) | 18 | downstream |
| CEP290-1857 | + | GAUGCAGAACUAGUGUAGA (2666) | 19 | downstream |
| CEP290-1858 | − | GAUGUAGAUUGAGGUAGAAUC (2667) | 21 | downstream |
| CEP290-1859 | − | GUAGAUUGAGGUAGAAUC (2668) | 18 | downstream |
| CEP290-1860 | + | GAAUGAUCAUUCUUGUGGCAGUA (2669) | 23 | downstream |
| CEP290-1861 | + | GAUCAUUCUUGUGGCAGUA (2670) | 19 | downstream |
| CEP290-1862 | + | GAAUGAUCAUUCUUGUGGCAGU (2671) | 22 | downstream |
| CEP290-1863 | + | GAUCAUUCUUGUGGCAGU (2672) | 18 | downstream |
| CEP290-1864 | − | GAGAGGUAAAGGUUCAUGAGAC (2673) | 22 | downstream |
| CEP290-1865 | − | GAGGUAAAGGUUCAUGAGAC (2674) | 20 | downstream |
| CEP290-1866 | − | GGUAAAGGUUCAUGAGAC (2675) | 18 | downstream |
| CEP290-1867 | + | GGUAGCUUUUGACAGUUUUUAAG (2676) | 23 | downstream |

TABLE 8E-continued

| gRNA Name | DNA Strand | Targeting Domain (SEQ ID NO) | Target Site Length | |
|---|---|---|---|---|
| CEP290-1868 | + | GUAGCUUUUGACAGUUUUUAAG (2677) | 22 | downstream |
| CEP290-1869 | + | GCUUUUGACAGUUUUUAAG (2678) | 19 | downstream |
| CEP290-1870 | + | GUAGCUUUUGACAGUUUUUAAGGC (2679) | 24 | downstream |
| CEP290-1871 | + | GCUUUUGACAGUUUUUAAGGC (2680) | 21 | downstream |
| CEP290-1872 | + | GAAAUUCACUGAGCAAACAAC (2681) | 22 | downstream |
| CEP290-1873 | + | GUGGCAGUAAGGAGGAUGUAAGA (2682) | 23 | downstream |
| CEP290-1874 | + | GGCAGUAAGGAGGAUGUAAGA (2683) | 21 | downstream |
| CEP290-1875 | + | GCAGUAAGGAGGAUGUAAGA (2684) | 20 | downstream |
| CEP290-1876 | − | GGAAAUUAUUGUUGCUUUUU (2685) | 20 | downstream |
| CEP290-1877 | − | GAAAUUAUUGUUGCUUUUU (2686) | 19 | downstream |
| CEP290-1878 | − | GAAAACUUGAAAUUUGAUAG (2687) | 21 | downstream |
| CEP290-1879 | − | GAAGAAAAAAGAAAUAGAUGUAGA (2688) | 24 | downstream |
| CEP290-1880 | − | GAAAAAAGAAAUAGAUGUAGA (2689) | 21 | downstream |
| CEP290-1881 | − | GUGUUGCCCAGGCUGGAGUGCA (2690) | 22 | downstream |
| CEP290-1882 | − | GUUGCCCAGGCUGGAGUGCA (2691) | 20 | downstream |
| CEP290-1883 | − | GAGUCUCACUGUGUUGCCCAGG (2692) | 22 | downstream |
| CEP290-1884 | − | GUCUCACUGUGUUGCCCAGG (2693) | 20 | downstream |
| CEP290-1885 | + | UUUUUAAGGCGGGGAGUCACA (2694) | 21 | downstream |
| CEP290-1886 | + | UUUUAAGGCGGGGAGUCACA (2695) | 20 | downstream |
| CEP290-1887 | + | UUUAAGGCGGGGAGUCACA (2696) | 19 | downstream |
| CEP290-1888 | + | UUAAGGCGGGGAGUCACA (2697) | 18 | downstream |
| CEP290-1889 | − | UGUCAAAAGCUACCGGUUAC (2698) | 20 | downstream |
| CEP290-1890 | − | UCAAAAGCUACCGGUUAC (2699) | 18 | downstream |
| CEP290-1891 | + | UUCAUCUCUUGCUCUAGAUGAC (2700) | 22 | downstream |
| CEP290-1892 | + | UCAUCUCUUGCUCUAGAUGAC (2701) | 21 | downstream |
| CEP290-1893 | + | UCUCUUGCUCUAGAUGAC (2702) | 18 | downstream |
| CEP290-1894 | − | UCACGAAAAUCAGAUUUCAUGU (2703) | 22 | downstream |
| CEP290-1895 | − | UAAUACAUGAGAGUGAUUAGUG (2704) | 22 | downstream |
| CEP290-1896 | − | UACAUGAGAGUGAUUAGUG (2705) | 19 | downstream |
| CEP290-1897 | + | UAUUAGCUUGAACUCUGUGCCAAA (2706) | 24 | downstream |
| CEP290-1898 | + | UUAGCUUGAACUCUGUGCCAAA (2707) | 22 | downstream |
| CEP290-1899 | + | UAGCUUGAACUCUGUGCCAAA (2708) | 21 | downstream |

TABLE 8E-continued

| gRNA Name | DNA Strand | Targeting Domain (SEQ ID NO) | Target Site Length | |
|---|---|---|---|---|
| CEP290-1900 | + | UUGCUCUAGAUGACAUGAGGUAAG (2709) | 24 | downstream |
| CEP290-1901 | + | UGCUCUAGAUGACAUGAGGUAAG (2710) | 23 | downstream |
| CEP290-1902 | + | UCUAGAUGACAUGAGGUAAG (2711) | 20 | downstream |
| CEP290-1903 | + | UAGAUGACAUGAGGUAAG (2712) | 18 | downstream |
| CEP290-1904 | − | UGUAGAUUGAGGUAGAAUCAAG (2713) | 22 | downstream |
| CEP290-1905 | − | UAGAUUGAGGUAGAAUCAAG (2714) | 20 | downstream |
| CEP290-1906 | + | UAUAAGAUGCAGAACUAGUGUAGA (2715) | 24 | downstream |
| CEP290-1907 | + | UAAGAUGCAGAACUAGUGUAGA (2716) | 22 | downstream |
| CEP290-1908 | − | UAGAUGUAGAUUGAGGUAGAAUC (2717) | 23 | downstream |
| CEP290-1909 | − | UGUAGAUUGAGGUAGAAUC (2718) | 19 | downstream |
| CEP290-1910 | + | UGAUCAUUCUUGUGGCAGUA (2719) | 20 | downstream |
| CEP290-1911 | + | UAGAAUGAUCAUUCUUGUGGCAGU (2720) | 24 | downstream |
| CEP290-1912 | + | UGAUCAUUCUUGUGGCAGU (2721) | 19 | downstream |
| CEP290-1913 | − | UUGAGAGGUAAAGGUUCAUGAGAC (2722) | 24 | downstream |
| CEP290-1914 | − | UGAGAGGUAAAGGUUCAUGAGAC (2723) | 23 | downstream |
| CEP290-1915 | + | UAGCUUUGACAGUUUUUAAG (2724) | 21 | downstream |
| CEP290-1916 | + | UAGCUUUGACAGUUUUUAAGGC (2725) | 23 | downstream |
| CEP290-1917 | + | UUUUGACAGUUUUUAAGGC (2726) | 19 | downstream |
| CEP290-1918 | + | UUUGACAGUUUUUAAGGC (2727) | 18 | downstream |
| CEP290-1919 | + | UAGAAAUUCACUGAGCAAAACAAC (2728) | 24 | downstream |
| CEP290-1920 | + | UUCACUGAGCAAAACAAC (2729) | 18 | downstream |
| CEP290-1921 | + | UGUGGCAGUAAGGAGGAUGUAAGA (2730) | 24 | downstream |
| CEP290-1922 | + | UGGCAGUAAGGAGGAUGUAAGA (2731) | 22 | downstream |
| CEP290-1923 | + | UAUCAAAAGACUUAUAUUCCAUUA (2732) | 24 | downstream |
| CEP290-1924 | + | UCAAAAGACUUAUAUUCCAUUA (2733) | 22 | downstream |
| CEP290-1925 | − | UUAGGAAAUUAUUGUUGCUUUUU (2734) | 23 | downstream |
| CEP290-1926 | − | UAGGAAAUUAUUGUUGCUUUUU (2735) | 22 | downstream |
| CEP290-1927 | − | UGUGUUGCCCAGGCUGGAGUGCA (2736) | 23 | downstream |
| CEP290-1928 | − | UGUUGCCCAGGCUGGAGUGCA (2737) | 21 | downstream |

TABLE 8E-continued

| gRNA Name | DNA Strand | Targeting Domain (SEQ ID NO) | Target Site Length | |
|---|---|---|---|---|
| CEP290-1929 | − | UUGCCCAGGCUGGAGUGCA (2738) | 19 | downstream |
| CEP290-1930 | − | UGCCCAGGCUGGAGUGCA (2739) | 18 | downstream |
| CEP290-1931 | − | UCUCACUGUGUUGCCCAGG (2740) | 19 | downstream |
| CEP290-13 | + | AUGAGAUACUCACAAUUACAAC (2741) | 22 | upstream |
| CEP290-18 | + | GUAUGAGAUACUCACAAUUACAAC (2742) | 24 | upstream |
| CEP290-14 | + | UAUGAGAUACUCACAAUUACAAC (2743) | 23 | upstream |
| CEP290-19 | + | GGUAUGAGAUAUUCACAAUUACAA (2744) | 24 | upstream |

Table 9A provides targeting domains for break-induced deletion of genomic sequence including the mutation at the LCA10 target position in the CEP290 gene selected according to the first tier parameters. The targeting domains are within 1000 bp upstream of an Alu repeat, within 40 bp upstream of mutation, or 1000 bp downstream of the mutation, have good orthogonality, and start with G. It is contemplated herein that the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 9A

| gRNA Name | DNA Strand | Targeting Domain (SEQ ID NO) | Target Site Length | Position relative to mutation |
|---|---|---|---|---|
| CEP290-1932 | + | GGCAAAAGCAGCAGAAAGCA (591) | 20 | upstream |
| CEP290-1933 | − | GUGGCUGAAUGACUUCU (592) | 17 | upstream |
| CEP290-1934 | − | GUUGUUCUGAGUAGCUU (590) | 17 | upstream |
| CEP290-1935 | − | GACUAGAGGUCACGAAA (593) | 17 | downstream |
| CEP290-1936 | − | GAGUUCAAGCUAAUACAUGA (589) | 20 | downstream |

Table 9B provides targeting domains for break-induced deletion of genomic sequence including the mutation at the LCA10 target position in the CEP290 gene selected according to the second tier parameters. The targeting domains are within 1000 bp upstream of an Alu repeat, within 40 bp upstream of mutation, or 1000 bp downstream of the mutation, have good orthogonality, and do not start with G. It is contemplated herein that the targeting domain hybridizes to the target domain through complementary base pairing. Any of the targeting domains in the table can be used with a *N. meningitidis* Cas9 molecule that generates a double stranded break (Cas9 nuclease) or a single-stranded break (Cas9 nickase).

TABLE 9B

| gRNA Name | DNA Strand | Targeting Domain (SEQ ID NO) | Target Site Length | Position relative to mutation |
|---|---|---|---|---|
| CEP290-1937 | + | AAAAGCAGCAGAAAGCA (2745) | 17 | upstream |
| CEP290-1938 | − | AACGUUGUUCUGAGUAGCUU (2746) | 20 | upstream |

TABLE 9B-continued

| gRNA Name | DNA Strand | Targeting Domain (SEQ ID NO) | Target Site Length | Position relative to mutation |
|---|---|---|---|---|
| CEP290-1939 | − | AAUAGAGGCUUAUGGAU (2747) | 17 | upstream |
| CEP290-1940 | + | ACUUAAUGAGUGCUUCCCUC (2748) | 20 | upstream |
| CEP290-1941 | − | AGAAAUAGAGGCUUAUGGAU (2749) | 20 | upstream |
| CEP290-1942 | + | AGCAGAAAGCAAACUGA (2750) | 17 | upstream |
| CEP290-1943 | + | AGCAGCAGAAAGCAAACUGA (2751) | 20 | upstream |
| CEP290-1944 | + | AGGGUCUGGUCCAUAUU (2752) | 17 | upstream |
| CEP290-1945 | − | AUAGUGGCUGAAUGACUUCU (2753) | 20 | upstream |
| CEP290-1946 | + | AUGUCUGGUUAAAAGAG (2754) | 17 | upstream |
| CEP290-1947 | + | CAAAGGGUCUGGUCCAUAUU (2755) | 20 | upstream |
| CEP290-1948 | − | CAUCAGAAAUAGAGGCU (2756) | 17 | upstream |
| CEP290-1949 | − | CCUCAUCAGAAAUAGAGGCU (2757) | 20 | upstream |
| CEP290-1950 | − | CUGAGGACAGAACAAGC (2758) | 17 | upstream |
| CEP290-1951 | − | CUGCUGCUUUUGCCAAAGAG (2759) | 20 | upstream |
| CEP290-1952 | − | CUGCUUUUGCCAAAGAG (2760) | 17 | upstream |
| CEP290-1953 | + | UAAUGAGUGCUUCCCUC (2761) | 17 | upstream |
| CEP290-1954 | + | UAGAUGUCUGGUUAAAAGAG (2762) | 20 | upstream |
| CEP290-1955 | − | UCAUUCUCCUUAGGUCACUU (2763) | 20 | upstream |
| CEP290-1956 | − | UUACUGAGGACAGAACAAGC (2764) | 20 | upstream |
| CEP290-1957 | − | UUCUCCUUAGGUCACUU (2765) | 17 | upstream |
| CEP290-1958 | − | AAGAAAAAGAAAUAGA (2766) | 17 | downstream |
| CEP290-1959 | − | AGAUUGAGGUAGAAUCAAGA (2767) | 20 | downstream |
| CEP290-1960 | + | AGUCACAUGGGAGUCACAGG (2768) | 20 | downstream |
| CEP290-1961 | + | CAAAAAAGAAUCCUCU (2769) | 17 | downstream |
| CEP290-1962 | + | CAACAAAAAAGAAUCCUCU (2770) | 20 | downstream |
| CEP290-1963 | + | CACAUGGGAGUCACAGG (2771) | 17 | downstream |
| CEP290-1964 | + | CAUUCUUCACACAUGAA (2772) | 17 | downstream |
| CEP290-1965 | − | UAGAAGAAAAAGAAAUAGA (2773) | 20 | downstream |
| CEP290-1966 | − | UGAGACUAGAGGCACGAAA (2774) | 20 | downstream |
| CEP290-1967 | − | UUCAAGCUAAUACAUGA (2775) | 17 | downstream |

TABLE 9B-continued

| gRNA Name | DNA Strand | Targeting Domain (SEQ ID NO) | Target Site Length | Position relative to mutation |
|---|---|---|---|---|
| CEP290-1968 | + | UUCCAUUCUUCACACAUGAA (2776) | 20 | downstream |
| CEP290-1969 | − | UUGAGGUAGAAUCAAGA (2777) | 17 | downstream |

Table 10 provides targeting domains for break-induced deletion of genomic sequence including the mutation at the LCA10 target position in the CEP290 gene by dual targeting (e.g., dual double strand cleavage). Exemplary gRNA pairs to be used with S. aureus Cas9 are shown in Table 10, e.g., CEP290-323 can be combined with CEP290-11, CEP290-323 can be combined with CEP290-64, CEP290-490 can be combined with CEP290-496, CEP290-490 can be combined with CEP290-502, CEP290-490 can be combined with CEP290-504, CEP290-492 can be combined with CEP290-502, or CEP290-492 can be combined with CEP290-504.

TABLE 10

| Upstream gRNA | (SEQ ID NO) | Downstream gRNA | (SEQ ID NO) |
|---|---|---|---|
| CEP290-323 | GTTCTGTCCTCAGTAAAAGGTA | CEP290-11 | GACACTGCCAATAGGGATAGG |
| CEP290-323 | GTTCTGTCCTCAGTAAAAGGTA | CEP290-64 | GTCAAAAGCTACCGGTTACCTG |
| CEP290-490 | GAATAGTTTGTTCTGGGTAC | CEP290-496 | GATGCAGAACTAGTGTAGAC |
| CEP290-490 | GAATAGTTTGTTCTGGGTAC | CEP290-502 | GTCACATGGGAGTCACAGGG |
| CEP290-490 | GAATAGTTTGTTCTGGGTAC | CEP290-504 | GAGTATCTCCTGTTTGGCA |
| CEP290-492 | GAGAAAGGGATGGGCACTTA | CEP290-502 | GTCACATGGGAGTCACAGGG |
| CEP290-492 | GAGAAAGGGATGGGCACTTA | CEP290-504 | GAGTATCTCCTGTTTGGCA |

III. Cas9 Molecules

Cas9 molecules of a variety of species can be used in the methods and compositions described herein. While the *S. pyogenes*, *S. aureus*, and *S. thermophilus* Cas9 molecules are the subject of much of the disclosure herein, Cas9 molecules of, derived from, or based on the Cas9 proteins of other species listed herein can be used as well. In other words, while the much of the description herein uses *S. pyogenes* and *S. thermophilus* Cas9 molecules Cas9 molecules from the other species can replace them. Such species include: *Acidovorax avenae, Actinobacillus pleuropneumoniae, Actinobacillus succinogenes, Actinobacillus suis, Actinomyces* sp., *Cycliphilusdenitrificans, Aminomonas paucivorans, Bacillus cereus, Bacillus smithii, Bacillus thuringiensis, Bacteroides* sp., *Blastopirellula marina, Bradyrhizobium* sp., *Brevibacillus laterosporus, Campylobacter coli, Campylobacter jejuni, Campylobacter lari, Candidatus puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, Gammaproteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria meningitidis, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus aureus, Staphylococcus lugdunensis, Streptococcus* sp., *Subdoligranulum* sp., *Tistrella mobilis, Treponema* sp., or *Verminephrobacter eiseniae*.

A Cas9 molecule, or Cas9 polypeptide, as that term is used herein, refers to a molecule or polypeptide that can interact with a guide RNA (gRNA) molecule and, in concert with the gRNA molecule, homes or localizes to a site which comprises a target domain and PAM sequence. Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule or a sequence of Table 11.

Cas9 Domains

Crystal structures have been determined for two different naturally occurring bacterial Cas9 molecules (Jinek et al., Science, 343(6176):1247997, 2014) and for *S. pyogenes* Cas9 with a guide RNA (e.g., a synthetic fusion of crRNA and tracrRNA) (Nishimasu et al., Cell, 156:935-949, 2014; and Anders et al., Nature, 2014, doi: 10.1038/nature13579).

A naturally occurring Cas9 molecule comprises two lobes: a recognition (REC) lobe and a nuclease (NUC) lobe; each of which further comprises domains described herein. FIGS. 8A-8B provide a schematic of the organization of important Cas9 domains in the primary structure. The domain nomenclature and the numbering of the amino acid residues encompassed by each domain used throughout this disclosure is as described in Nishimasu et al. The numbering of the amino acid residues is with reference to Cas9 from *S. pyogenes*.

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of the sequence of *S. pyogenes* Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of *S. pyogenes* Cas9.

The NUC lobe comprises the RuvC domain (also referred to herein as RuvC-like domain), the HNH domain (also referred to herein as HNH-like domain), and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

A RuvC-Like Domain and an HNH-Like Domain

In an embodiment, a Cas9 molecule or Cas9 polypeptide comprises an HNH-like domain and a RuvC-like domain. In an embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In an embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

RuvC-Like Domains

In an embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain. Exemplary N-terminal RuvC-like domains are described below.

In an embodiment, an eaCas9 molecule or eaCas9 polypeptide comprises an N-terminal RuvC-like domain comprising an amino acid sequence of formula I:

D-X1-G-X2-X3-X4-X5-G-X6-X7-X8-X9,  (SEQ ID NO: 8)

wherein, $X_1$ is selected from I, V, M, L and T (e.g., selected from I, V, and L);

$X_2$ is selected from T, I, V, S, N, Y, E and L (e.g., selected from T, V, and I);

$X_3$ is selected from N, S, G, A, D, T, R, M and F (e.g., A or N);

$X_4$ is selected from S, Y, N and F (e.g., S);

$X_5$ is selected from V, I, L, C, T and F (e.g., selected from V, I and L);

$X_6$ is selected from W, F, V, Y, S and L (e.g., W);

$X_7$ is selected from A, S, C, V and G (e.g., selected from A and S);

$X_8$ is selected from V, I, L, A, M and H (e.g., selected from V, I, M and L); and $X_9$ is selected from any amino acid or is absent, designated by Δ (e.g., selected from T, V, I, L, Δ, F, S, A, Y, M and R, or, e.g., selected from T, V, I, L and Δ).

In an embodiment, the N-terminal RuvC-like domain differs from a sequence of SEQ ID NO:8, by as many as 1 but no more than 2, 3, 4, or 5 residues.

In embodiment, the N-terminal RuvC-like domain is cleavage competent.

In embodiment, the N-terminal RuvC-like domain is cleavage incompetent.

In an embodiment, a eaCas9 molecule or eaCas9 polypeptide comprises an N-terminal RuvC-like domain comprising an amino acid sequence of formula II:

D-X1-G-X2-X3-S-X5-G-X6-X7-X8-X9,,  (SEQ ID NO: 9)

wherein $X_1$ is selected from I, V, M, L and T (e.g., selected from I, V, and L);

$X_2$ is selected from T, I, V, S, N, Y, E and L (e.g., selected from T, V, and I);

$X_3$ is selected from N, S, G, A, D, T, R, M and F (e.g., A or N);

$X_5$ is selected from V, I, L, C, T and F (e.g., selected from V, I and L);

$X_6$ is selected from W, F, V, Y, S and L (e.g., W);

$X_7$ is selected from A, S, C, V and G (e.g., selected from A and S);

$X_8$ is selected from V, I, L, A, M and H (e.g., selected from V, I, M and L); and $X_9$ is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:9 by as many as 1 but no more than 2, 3, 4, or 5 residues.

In an embodiment, the N-terminal RuvC-like domain comprises an amino acid sequence of formula III:

```
D-I-G-X2-X3-S-V-G-W-A-X8-X9,    (SEQ ID NO: 10)
``` wherein

X2 is selected from T, I, V, S, N, Y, E and L (e.g., selected from T, V, and I);

X3 is selected from N, S, G, A, D, T, R, M and F (e.g., A or N);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:10 by as many as 1 but no more than, 2, 3, 4, or 5 residues.

In an embodiment, the N-terminal RuvC-like domain comprises an amino acid sequence of formula III:

```
D-I-G-T-N-S-V-G-W-A-V-X,    (SEQ ID NO: 11)
``` wherein

X is a non-polar alkyl amino acid or a hydroxyl amino acid, e.g., X is selected from V, I, L and T (e.g., the eaCas9 molecule can comprise an N-terminal RuvC-like domain shown in FIGS. 2A-2G (is depicted as Y)).

In an embodiment, the N-terminal RuvC-like domain differs from a sequence of SEQ ID NO:11 by as many as 1 but no more than, 2, 3, 4, or 5 residues.

In an embodiment, the N-terminal RuvC-like domain differs from a sequence of an N-terminal RuvC like domain disclosed herein, e.g., in FIGS. 3A-3B or FIGS. 7A-7B, as many as 1 but no more than 2, 3, 4, or 5 residues. In an embodiment, 1, 2, or all 3 of the highly conserved residues identified in FIGS. 3A-3B or FIGS. 7A-7B are present.

In an embodiment, the N-terminal RuvC-like domain differs from a sequence of an N-terminal RuvC-like domain disclosed herein, e.g., in FIGS. 4A-4B or FIGS. 7A-7B, as many as 1 but no more than 2, 3, 4, or 5 residues. In an embodiment, 1, 2, 3 or all 4 of the highly conserved residues identified in FIGS. 4A-4B or FIGS. 7A-7B are present.

Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In an embodiment, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence:

I-X1-X2-E-X3-A-R-E (SEQ ID NO:12), wherein

X1 is V or H,

X2 is I, L or V (e.g., I or V); and

X3 is M or T.

In an embodiment, the additional RuvC-like domain comprises the amino acid sequence:

I-V-X2-E-M-A-R-E (SEQ ID NO:13), wherein

X2 is I, L or V (e.g., I or V) (e.g., the eaCas9 molecule or eaCas9 polypeptide can comprise an additional RuvC-like domain shown in FIG. 2A-2G or FIGS. 7A-7B (depicted as B)).

An additional RuvC-like domain can comprise an amino acid sequence:

H-H-A-X1-D-A-X2-X3 (SEQ ID NO:14), wherein

X1 is H or L;

X2 is R or V; and

X3 is E or V.

In an embodiment, the additional RuvC-like domain comprises the amino acid sequence:

```
H-H-A-H-D-A-Y-L.    (SEQ ID NO: 15)
```

In an embodiment, the additional RuvC-like domain differs from a sequence of SEQ ID NO:13, 15, 12 or 14 by as many as 1 but no more than 2, 3, 4, or 5 residues.

In some embodiments, the sequence flanking the N-terminal RuvC-like domain is a sequences of formula V:

```
K-X1'-Y-X2'-X3'-X4'-Z-T-D-X9'-Y,.    (SEQ ID NO: 16)
``` wherein

X1' is selected from K and P,

X2' is selected from V, L, I, and F (e.g., V, I and L);

X3' is selected from G, A and S (e.g., G),

X4' is selected from L, I, V and F (e.g., L);

X9' is selected from D, E, N and Q; and

Z is an N-terminal RuvC-like domain, e.g., as described above.

HNH-Like Domains

In an embodiment, an HNH-like domain cleaves a single stranded complementary domain, e.g., a complementary strand of a double stranded nucleic acid molecule. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

In an embodiment, an eaCas9 molecule or eaCas9 polypeptide comprises an HNH-like domain having an amino acid sequence of formula VI:

X1-X2-X3-H-X4-X5-P X6 X7 X8 X9 X10 X11 X12 X13 X14 X15 N-X16-X17-X18-X19 X20 X21 X22 X23 N (SEQ ID NO:17), wherein X1 is selected from D, E, Q and N (e.g., D and E);

X2 is selected from L, I, R, Q, V, M and K;

X3 is selected from D and E;

X4 is selected from I, V, T, A and L (e.g., A, I and V);

X5 is selected from V, Y, I, L, F and W (e.g., V, I and L);

X6 is selected from Q, H, R, K, Y, I, L, F and W;

X7 is selected from S, A, D, T and K (e.g., S and A);

X8 is selected from F, L, V, K, Y, M, I, R, A, E, D and Q (e.g., F);

X9 is selected from L, R, T, I, V, S, C, Y, K, F and G;

X10 is selected from K, Q, Y, T, F, L, W, M, A, E, G, and S;

X11 is selected from D, S, N, R, L and T (e.g., D);

X12 is selected from D, N and S;

X13 is selected from S, A, T, G and R (e.g., S);

X14 is selected from I, L, F, S, R, Y, Q, W, D, K and H (e.g., I, L and F);

X15 is selected from D, S, I, N, E, A, H, F, L, Q, M, G, Y and V;

X16 is selected from K, L, R, M, T and F (e.g., L, R and K);

X17 is selected from V, L, I, A and T;

X18 is selected from L, I, V and A (e.g., L and I);

X19 is selected from T, V, C, E, S and A (e.g., T and V);

X20 is selected from R, F, T, W, E, L, N, C, K, V, S, Q, I, Y, H and A;

X21 is selected from S, P, R, K, N, A, H, Q, G and L;

X22 is selected from D, G, T, N, S, K, A, I, E, L, Q, R and Y; and

X23 is selected from K, V, A, E, Y, I, C, L, S, T, G, K, M, D and F.

In an embodiment, a HNH-like domain differs from a sequence of SEQ ID NO:16 by at least one but no more than, 2, 3, 4, or 5 residues.

In an embodiment, the HNH-like domain is cleavage competent.

In an embodiment, the HNH-like domain is cleavage incompetent.

In an embodiment, an eaCas9 molecule or eaCas9 polypeptide comprises an HNH-like domain comprising an amino acid sequence of formula VII:

```
                                    (SEQ ID NO: 18)
X1-X2-X3-H-X4-X5-P-X6-S-X8-X9-X10-D-D-S-X14-X15-N-

K-V-L-X19-X20-X21-X22-X23-N,
``` wherein

X1 is selected from D and E;

X2 is selected from L, I, R, Q, V, M and K;

X3 is selected from D and E;

X4 is selected from I, V, T, A and L (e.g., A, I and V);

X5 is selected from V, Y, I, L, F and W (e.g., V, I and L);

X6 is selected from Q, H, R, K, Y, I, L, F and W;

X8 is selected from F, L, V, K, Y, M, I, R, A, E, D and Q (e.g., F);

X9 is selected from L, R, T, I, V, S, C, Y, K, F and G;

X10 is selected from K, Q, Y, T, F, L, W, M, A, E, G, and S;

X14 is selected from I, L, F, S, R, Y, Q, W, D, K and H (e.g., I, L and F);

X15 is selected from D, S, I, N, E, A, H, F, L, Q, M, G, Y and V;

X19 is selected from T, V, C, E, S and A (e.g., T and V);

X20 is selected from R, F, T, W, E, L, N, C, K, V, S, Q, I, Y, H and A;

X21 is selected from S, P, R, K, N, A, H, Q, G and L;

X22 is selected from D, G, T, N, S, K, A, I, E, L, Q, R and Y; and

X23 is selected from K, V, A, E, Y, I, C, L, S, T, G, K, M, D and F.

In an embodiment, the HNH-like domain differs from a sequence of SEQ ID NO:15 by 1, 2, 3, 4, or 5 residues.

In an embodiment, an eaCas9 molecule or eaCas9 polypeptide comprises an HNH-like domain comprising an amino acid sequence of formula VII:

```
                                    (SEQ ID NO: 19)
X1-V-X3-H-I-V-P-X6-S-X8-X9-X10-D-D-S-X14-X15-N-K-

V-L-T-X20-X21-X22-X23-N,
``` wherein

X1 is selected from D and E;

X3 is selected from D and E;

X6 is selected from Q, H, R, K, Y, I, L and W;

X8 is selected from F, L, V, K, Y, M, I, R, A, E, D and Q (e.g., F);

X9 is selected from L, R, T, I, V, S, C, Y, K, F and G;

X10 is selected from K, Q, Y, T, F, L, W, M, A, E, G, and S;

X14 is selected from I, L, F, S, R, Y, Q, W, D, K and H (e.g., I, L and F);

X15 is selected from D, S, I, N, E, A, H, F, L, Q, M, G, Y and V;

X20 is selected from R, F, T, W, E, L, N, C, K, V, S, Q, I, Y, H and A;

X21 is selected from S, P, R, K, N, A, H, Q, G and L;

X22 is selected from D, G, T, N, S, K, A, I, E, L, Q, R and Y; and

X23 is selected from K, V, A, E, Y, I, C, L, S, T, G, K, M, D and F.

In an embodiment, the HNH-like domain differs from a sequence of SEQ ID NO:GG by 1, 2, 3, 4, or 5 residues.

In an embodiment, an eaCas9 molecule or eaCas9 polypeptide comprises an HNH-like domain having an amino acid sequence of formula VIII:

```
                                    (SEQ ID NO: 20)
D-X2-D-H-I-X5-P-Q-X7-F-X9-X10-D-X12-S-I-D-N-X16-V-

L-X19-X20-S-X22-X23-N,
``` wherein

X2 is selected from I and V;

X5 is selected from I and V;

X7 is selected from A and S;

X9 is selected from I and L;

X10 is selected from K and T;

X12 is selected from D and N;

X16 is selected from R, K and L; X19 is selected from T and V;

X20 is selected from S and R;

X22 is selected from K, D and A; and

X23 is selected from E, K, G and N (e.g., the eaCas9 molecule or eaCas9 polypeptide can comprise an HNH-like domain as described herein).

In an embodiment, the HNH-like domain differs from a sequence of SEQ ID NO:19 by as many as 1 but no more than 2, 3, 4, or 5 residues.

In an embodiment, an eaCas9 molecule or eaCas9 polypeptide comprises the amino acid sequence of formula IX:

```
                                    (SEQ ID NO: 21)
L-Y-Y-L-Q-N-G-X1'-D-M-Y-X2'-X3'-X4'-X5'-L-D-I-X6'-

X7'-L-S-X8'-Y-Z-N-R-X9'-K-X10'-D-X11'-V-P,
``` wherein

X1' is selected from K and R;

X2' is selected from V and T;

X3' is selected from G and D;

X4' is selected from E, Q and D;

X5' is selected from E and D;

X6' is selected from D, N and H;

X7' is selected from Y, R and N;

X8' is selected from Q, D and N; X9' is selected from G and E;

X10' is selected from S and G;

X11' is selected from D and N; and

Z is an HNH-like domain, e.g., as described above.

In an embodiment, the eaCas9 molecule or eaCas9 polypeptide comprises an amino acid sequence that differs from a sequence of SEQ ID NO:21 by as many as 1 but no more than 2, 3, 4, or 5 residues.

In an embodiment, the HNH-like domain differs from a sequence of an HNH-like domain disclosed herein, e.g., in FIGS. 5A-5C or FIGS. 7A-7B, as many as 1 but no more than 2, 3, 4, or 5 residues. In an embodiment, 1 or both of the highly conserved residues identified in FIGS. 5A-5C or FIGS. 7A-7B are present.

In an embodiment, the HNH-like domain differs from a sequence of an HNH-like domain disclosed herein, e.g., in FIGS. 6A-6B or FIGS. 7A-7B, as many as 1 but no more than 2, 3, 4, or 5 residues. In an embodiment, 1, 2, all 3 of the highly conserved residues identified in FIGS. 6A-6B or FIGS. 7A-7B are present.

Cas9 Activities

Nuclease and Helicase Activities

In an embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 peolypeptide which is a nickase, or which lacks the ability to cleave target nucleic acid. A Cas9 molecule or Cas9 polypeptide that is capable of cleaving a target nucleic acid molecule is referred to herein as an eaCas9 molecule or eaCas9 polypeptide.

In an embodiment, an eaCas9 molecule or eaCas9 polypeptide comprises one or more of the following activities:

a nickase activity, i.e., the ability to cleave a single strand, e.g., the non-complementary strand or the complementary strand, of a nucleic acid molecule;

a double stranded nuclease activity, i.e., the ability to cleave both strands of a double stranded nucleic acid and create a double stranded break, which in an embodiment is the presence of two nickase activities;

an endonuclease activity;

an exonuclease activity; and a helicase activity, i.e., the ability to unwind the helical structure of a double stranded nucleic acid.

In an embodiment, an enzymatically active or eaCas9 molecule or eaCas9 polypeptide cleaves both strands and results in a double stranded break. In an embodiment, an eaCas9 molecule cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH-like domain. In an embodiment, an eaCas9 molecule or eaCas9 polypeptide comprises cleavage activity associated with an N-terminal RuvC-like domain. In an embodiment, an eaCas9 molecule or eaCas9 polypeptide comprises cleavage activity associated with an HNH-like domain and cleavage activity associated with an N-terminal RuvC-like domain. In an embodiment, an eaCas9 molecule or eaCas9 polypeptide comprises an active, or cleavage competent, HNH-like domain and an inactive, or cleavage incompetent, N-terminal RuvC-like domain. In an embodiment, an eaCas9 molecule or eaCas9 polypeptide comprises an inactive, or cleavage incompetent, HNH-like domain and an active, or cleavage competent, N-terminal RuvC-like domain.

Some Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

A Cas9 molecule or Cas9 polypeptide, is a polypeptide that can interact with a guide RNA (gRNA) molecule and, in concert with the gRNA molecule, localizes to a site which comprises a target domain and PAM sequence.

In an embodiment, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. EaCas9 molecules from different bacterial species can recognize different sequence motifs (e.g., PAM sequences). In an embodiment, an eaCas9 molecule of *S. pyogenes* recognizes the sequence motif NGG, NAG, NGA and directs cleavage of a target nucleic acid sequence 1 to 10, e.g., 3 to 5, base pairs upstream from that sequence. See, e.g., Mali et al., Science 2013; 339(6121): 823-826. In an embodiment, an eaCas9 molecule of *S. thermophilus* recognizes the sequence motif NGGNG and NNAGAAW (W=A or T) and directs cleavage of a core target nucleic acid sequence 1 to 10, e.g., 3 to 5, base pairs upstream from these sequences. See, e.g., Horvath et al., Science 2010; 327 (5962):167-170, and Deveau et al., J Bacteriol 2008; 190(4): 1390-1400. In an embodiment, an eaCas9 molecule of *S. mutans* recognizes the sequence motif NGG and/or NAAR (R=A or G) and directs cleavage of a core target nucleic acid sequence 1 to 10, e.g., 3 to 5 base pairs, upstream from this sequence. See, e.g., Deveau et al., J Bacteriol 2008; 190(4): 1390-1400. In an embodiment, an eaCas9 molecule of *S. aureus* recognizes the sequence motif NNGRR (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRN (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRT (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRV (R=A or G, V=A, G or C) and directs cleavage of a target nucleic acid sequence 1 to 10, e.g., 3 to 5, base pairs upstream from that sequence. In an embodiment, an eaCas9 molecule of *Neisseria meningitidis* recognizes the sequence motif NNNNGATT or NNNGCTT and directs cleavage of a target nucleic acid sequence 1 to 10, e.g., 3 to 5, base pairs upstream from that sequence. See, e.g., Hou et al., PNAS Early Edition 2013, 1-6. The ability of a Cas9 molecule to recognize a PAM sequence can be determined, e.g., using a transformation assay described in Jinek et al., Science 2012 337:816. In the aforementioned embodiments, N can be any nucleotide residue, e.g., any of A, G, C or T.

As is discussed herein, Cas9 molecules can be engineered to alter the PAM specificity of the Cas9 molecule.

Exemplary naturally occurring Cas9 molecules are described in Chylinski et al., RNA BIOLOGY 2013 10:5, 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408). Another exemplary Cas9 molecule is a Cas9 molecule of *Neisseria meningitidis* (Hou et al., PNAS Early Edition 2013, 1-6).

In an embodiment, a Cas9 molecule or Cas9 polypeptide, e.g., an eaCas9 molecule or eaCas9 polypeptide, comprises an amino acid sequence:

having 60%, 65%, 70%, 75%, 80%, 85%, 90%, 95%, 96%, 97%, 98% or 99% homology with;

differs at no more than, 2, 5, 10, 15, 20, 30, or 40% of the amino acid residues when compared with;

differs by at least 1, 2, 5, 10 or 20 amino acids but by no more than 100, 80, 70, 60, 50, 40 or 30 amino acids from; or is identical to any Cas9 molecule sequence described herein, or a naturally occurring Cas9 molecule sequence, e.g., a Cas9 molecule from a species listed herein or described in Chylinski et al., RNA BIOLOGY 2013 10:5, 727-737; Hou et al., PNAS Early Edition 2013, 1-6; SEQ ID NOS:1-4. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to home to a target nucleic acid.

In an embodiment, a Cas9 molecule or Cas9 polypeptide comprises the amino acid sequence of the consensus sequence of FIGS. 2A-2G, wherein "*" indicates any amino acid found in the corresponding position in the amino acid sequence of a Cas9 molecule of *S. pyogenes, S. thermophilus, S. mutans* and *L. innocua*, and "-" indicates any amino acid. In an embodiment, a Cas9 molecule or Cas9 polypeptide differs from the sequence of the consensus sequence disclosed in FIGS. 2A-2G by at least 1, but no more than 2, 3, 4, 5, 6, 7, 8, 9, or 10 amino acid residues. In an embodiment, a Cas9 molecule or Cas9 polypeptide comprises the amino acid sequence of SEQ ID NO:7 of FIGS. 7A-7B, wherein "*" indicates any amino acid found in the corresponding position in the amino acid sequence of a Cas9 molecule of *S. pyogenes*, or *N. meningitidis*, "-" indicates any amino acid, and "-" indicates any amino acid or absent. In an embodiment, a Cas9 molecule or Cas9 polypeptide differs from the sequence of SEQ ID NO:6 or 7 disclosed in FIGS. 7A-7B by at least 1, but no more than 2, 3, 4, 5, 6, 7, 8, 9, or 10 amino acid residues.

A comparison of the sequence of a number of Cas9 molecules indicate that certain regions are conserved. These are identified below as:

region 1 (residues 1 to 180, or in the case of region 1' residues 120 to 180)

region 2 (residues 360 to 480);

region 3 (residues 660 to 720);

region 4 (residues 817 to 900); and region 5 (residues 900 to 960);

In an embodiment, a Cas9 molecule or Cas9 polypeptide comprises regions 1-5, together with sufficient additional Cas9 molecule sequence to provide a biologically active molecule, e.g., a Cas9 molecule having at least one activity described herein. In an embodiment, each of regions 1-6, independently, have, 50%, 60%, 70%, or 80% homology with the corresponding residues of a Cas9 molecule or Cas9 polypeptide described herein, e.g., a sequence from FIGS. 2A-2G or from FIGS. 7A-7B.

In an embodiment, a Cas9 molecule or Cas9 polypeptide, e.g., an eaCas9 molecule or eaCas9 polypeptide, comprises an amino acid sequence referred to as region 1:

having 50%, 60%, 70%, 80%, 85%, 90%, 95%, 96%, 97%, 98% or 99% homology with amino acids 1-180 (the numbering is according to the motif sequence in FIGS. 2A-2G; 52% of residues in the four Cas9 sequences in FIGS. 2A-2G are conserved) of the amino acid sequence of Cas9 of *S. pyogenes*;

differs by at least 1, 2, 5, 10 or 20 amino acids but by no more than 90, 80, 70, 60, 50, 40 or 30 amino acids from amino acids 1-180 of the amino acid sequence of Cas9 of *S. pyogenes, S. thermophilus, S. mutans* or *L. innocua*; or is identical to 1-180 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 1':

having 55%, 60%, 65%, 70%, 75%, 80%, 85%, 90%, 95%, 96%, 97%, 98% or 99% homology with amino acids 120-180 (55% of residues in the four Cas9 sequences in FIGS. 2A-2G are conserved) of the amino acid sequence of Cas9 of *S. pyogenes, S. thermophilus, S. mutans* or *L. innocua*;

differs by at least 1, 2, or 5 amino acids but by no more than 35, 30, 25, 20 or 10 amino acids from amino acids 120-180 of the amino acid sequence of Cas9 of *S. pyogenes, S. thermophilus, S. mutans* or *L. innocua*; or is identical to 120-180 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 2:

having 50%, 55%, 60%, 65%, 70%, 75%, 80%, 85%, 90%, 95%, 96%, 97%, 98% or 99% homology with amino acids 360-480 (52% of residues in the four Cas9 sequences in FIGS. 2A-2G are conserved) of the amino acid sequence of Cas9 of *S. pyogenes, S. thermophilus, S. mutans* or *L. innocua*;

differs by at least 1, 2, or 5 amino acids but by no more than 35, 30, 25, 20 or 10 amino acids from amino acids 360-480 of the amino acid sequence of Cas9 of *S. pyogenes, S. thermophilus, S. mutans* or *L. innocua*; or is identical to 360-480 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 3:

having 55%, 60%, 65%, 70%, 75%, 80%, 85%, 90%, 95%, 96%, 97%, 98%, or 99% homology with amino acids 660-720 (56% of residues in the four Cas9 sequences in FIGS. 2A-2G are conserved) of the amino acid sequence of Cas9 of *S. pyogenes, S. thermophilus, S. mutans* or *L. innocua*;

differs by at least 1, 2, or 5 amino acids but by no more than 35, 30, 25, 20 or 10 amino acids from amino acids 660-720 of the amino acid sequence of Cas9 of *S. pyogenes, S. thermophilus, S. mutans* or *L. innocua*; or is identical to 660-720 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 4:

having 50%, 55%, 60%, 65%, 70%, 75%, 80%, 85%, 90%, 95%, 96%, 97%, 98%, or 99% homology with amino acids 817-900 (55% of residues in the four Cas9 sequences in FIGS. 2A-2G are conserved) of the amino acid sequence of Cas9 of *S. pyogenes, S. thermophilus, S. mutans* or *L. innocua*;

differs by at least 1, 2, or 5 amino acids but by no more than 35, 30, 25, 20 or 10 amino acids from amino acids 817-900 of the amino acid sequence of Cas9 of *S. pyogenes, S. thermophilus, S. mutans* or *L. innocua*; or is identical to 817-900 of the amino acid sequence of Cas9 of *S. pyogenes, S. thermophilus, S. mutans* or *L. innocua*.

In an embodiment, a Cas9 molecule or Cas9 polypeptide, e.g., an eaCas9 molecule or eaCas9 polypeptide, comprises an amino acid sequence referred to as region 5:

having 50%, 55%, 60%, 65%, 70%, 75%, 80%, 85%, 90%, 95%, 96%, 97%, 98%, or 99% homology with amino acids 900-960 (60% of residues in the four Cas9 sequences in FIGS. 2A-2G are conserved) of the amino acid sequence of Cas9 of *S. pyogenes, S. thermophilus, S. mutans* or *L. innocua*;

differs by at least 1, 2, or 5 amino acids but by no more than 35, 30, 25, 20 or 10 amino acids from amino acids 900-960 of the amino acid sequence of Cas9 of *S. pyogenes, S. thermophilus, S. mutans* or *L. innocua*; or is identical to 900-960 of the amino acid sequence of Cas9 of *S. pyogenes, S. thermophilus, S. mutans* or *L. innocua*.

Engineered or Altered Cas9 Molecules and Cas9 Polypeptides

Cas9 molecules and Cas9 polypeptides described herein, e.g., naturally occurring Cas9 molecules, can possess any of a number of properties, including: nickase activity, nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecule or Cas9 polypeptide can include all or a subset of these properties. In typical embodiments, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. E.g., an engineered Cas9 molecule can be altered to recognize a PAM sequence other than that recognized by the endogenous wild-type PI domain. In an embodiment, a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring, Cas9 molecules or Cas9 polypeptides, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In an embodiment, a Cas9 molecule or Cas9 polypeptide can comprises one or more mutations or differences, e.g., at least 1, 2, 3, 4, 5, 10, 15, 20, 30, 40 or 50 mutations, but less than 200, 100, or 80 mutations relative to a reference, e.g., a parental, Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein.

Non-Cleaving and Modified-Cleavage Cas9 Molecules and Cas9 Polypeptides

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of S. pyogenes, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of S. pyogenes); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of S. pyogenes); or the ability to cleave a nucleic acid molecule, e.g., a double stranded or single stranded nucleic acid molecule, can be eliminated.

Modified Cleavage eaCas9 Molecules and eaCas9 Polypeptides

In an embodiment, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In an embodiment, an eaCas9 molecule or eaCas9 polypeptide comprises an active, or cleavage competent, HNH-like domain (e.g., an HNH-like domain described herein, e.g., SEQ ID NO:17, SEQ ID NO:18, SEQ ID NO:19, SEQ ID NO: 20, or SEQ ID NO:21) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 9 of the consensus sequence disclosed in FIGS. 2A-2G or an aspartic acid at position 10 of SEQ ID NO:7, e.g., can be substituted with an alanine. In an embodiment, the eaCas9 molecule or eaCas9 polypeptide differs from wild type in the N-terminal RuvC-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, or S. thermophilus. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain (e.g., an N-terminal RuvC-like domain described herein, e.g., SEQ ID NO:8, SEQ ID NO:9, SEQ ID NO:10, SEQ ID NO:11, SEQ ID NO: 12, SEQ ID NO:13, SEQ ID NO:14, SEQ ID NO:15, or SEQ ID NO:16). Exemplary inactive, or cleavage incompetent HNH-like domains can have a mutation at one or more of: a histidine in an HNH-like domain, e.g., a histidine shown at position 856 of FIGS. 2A-2G, e.g., can be substituted with an alanine; and one or more asparagines in an HNH-like domain, e.g., an asparagine shown at position 870 of FIGS. 2A-2G and/or at position 879 of FIGS. 2A-2G, e.g., can be substituted with an alanine. In an embodiment, the eaCas9 differs from wild type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, or S. thermophilus. In an embodiment, the reference Cas9 molecule is the naturally occurring Cas9 molecule having the closest sequence identity or homology.

Alterations in the Ability to Cleave One or Both Strands of a Target Nucleic Acid In an embodiment, exemplary Cas9 activities comprise one or more of PAM specificity, cleavage activity, and helicase activity. A mutation(s) can be present, e.g., in one or more RuvC-like domain, e.g., an N-terminal RuvC-like domain; an HNH-like domain; a region outside the RuvC-like domains and the HNH-like domain. In some embodiments, a mutation(s) is present in a RuvC-like domain, e.g., an N-terminal RuvC-like domain. In some embodiments, a mutation(s) is present in an HNH-like domain. In some embodiments, mutations are present in both a RuvC-like domain, e.g., an N-terminal RuvC-like domain, and an HNH-like domain.

Exemplary mutations that may be made in the RuvC domain or HNH domain with reference to the S. pyogenes sequence include: D10A, E762A, H840A, N854A, N863A and/or D986A.

In an embodiment, a Cas9 molecule or Cas9 polypeptide is an eiCas9 molecule or eiCas9 polypeptide comprising one or more differences in a RuvC domain and/or in an HNH domain as compared to a reference Cas9 molecule, and the eiCas9 molecule or eiCas9 polypeptide does not cleave a nucleic acid, or cleaves with significantly less efficiency than does wildype, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative or by the method described in Section IV. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of S aureus, S. pyogenes, or C. jejuni as follows: its ability to modulate, e.g., decreased or increased, cleavage of a double stranded break (endonuclease and/or exonuclease activity), e.g., as compared to a naturally occurring Cas9 molecule (e.g., a Cas9 molecule of S aureus, S. pyogenes, or C. jejuni); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of *S aureus, S. pyogenes*, or *C. jejuni*); or the ability to cleave a nucleic acid molecule, e.g., a double stranded or single stranded nucleic acid molecule, can be eliminated.

In an embodiment, the altered Cas9 molecule or Cas9 polypeptide is an eaCas9 molecule or eaCas9 polypeptide comprising one or more of the following activities: cleavage activity associated with a RuvC domain; cleavage activity associated with an HNH domain; cleavage activity associated with an HNH domain and cleavage activity associated with a RuvC domain.

In an embodiment, the altered Cas9 molecule or Cas9 polypeptide is an eiCas9 molecule or eiCas9 polypeptide which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of *S. pyogenes, S. thermophilus, S. aureus, C. jejuni* or *N. meningitidis*. In an embodiment, the reference Cas9 molecule is the naturally occurring Cas9 molecule having the closest sequence identity or homology. In an embodiment, the eiCas9 molecule or eiCas9 polypeptide lacks substantial cleavage activity associated with a RuvC domain and cleavage activity associated with an HNH domain.

In an embodiment, the altered Cas9 molecule or Cas9 polypeptide is an eaCas9 molecule or eaCas9 polypeptide comprising the fixed amino acid residues of *S. pyogenes* shown in the consensus sequence disclosed in FIGS. 2A-2G, and has one or more amino acids that differ from the amino acid sequence of *S. pyogenes* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G or SEQ ID NO:7.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *S. pyogenes* Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an *S. pyogenes* Cas9 molecule.

In an embodiment, the altered Cas9 molecule or Cas9 polypeptide is an eaCas9 molecule or eaCas9 polypeptide comprising the fixed amino acid residues of *S. thermophilus* shown in the consensus sequence disclosed in FIGS. 2A-2G, and has one or more amino acids that differ from the amino acid sequence of *S. thermophilus* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *S. thermophilus* Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an *S. thermophilus* Cas9 molecule.

In an embodiment, the altered Cas9 molecule or Cas9 polypeptide is an eaCas9 molecule or eaCas9 polypeptide comprising the fixed amino acid residues of *S. mutans* shown in the consensus sequence disclosed in FIGS. 2A-2G, and has one or more amino acids that differ from the amino acid sequence of *S. mutans* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *S. mutans* Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an *S. mutans* Cas9 molecule.

In an embodiment, the altered Cas9 molecule or Cas9 polypeptide is an eaCas9 molecule or eaCas9 polypeptide comprising the fixed amino acid residues of *L. innocula* shown in the consensus sequence disclosed in FIGS. 2A-2G, and has one or more amino acids that differ from the amino acid sequence of *L. innocula* (e.g., has a substitution) at one or more residue (e.g., 2, 3, 5, 10, 15, 20, 30, 50, 70, 80, 90, 100, 200 amino acid residues) represented by an "-" in the consensus sequence disclosed in FIGS. 2A-2G.

In an embodiment, the altered Cas9 molecule or Cas9 polypeptide comprises a sequence in which:

the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;

the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *L. innocula* Cas9 molecule; and, the sequence corresponding to the residues identified by "-" in the consensus sequence disclosed in FIGS. 2A-2G differ at no more than 5, 10, 15, 20, 25, 30, 35, 40, 45, 55, or 60% of the "-" residues from the corresponding sequence of naturally occurring Cas9 molecule, e.g., an *L. innocula* Cas9 molecule.

In an embodiment, the altered Cas9 molecule or Cas9 polypeptide, e.g., an eaCas9 molecule, can be a fusion, e.g., of two of more different Cas9 molecules or Cas9 polypeptides, e.g., of two or more naturally occurring Cas9 molecules of different species. For example, a fragment of a naturally occurring Cas9 molecule of one species can be fused to a fragment of a Cas9 molecule of a second species. As an example, a fragment of Cas9 molecule of *S. pyogenes* comprising an N-terminal RuvC-like domain can be fused to a fragment of Cas9 molecule of a species other than *S. pyogenes* (e.g., *S. thermophilus*) comprising an HNH-like domain.

Cas9 Molecules and Cas9 Polypeptides with Altered PAM Recognition or No PAM Recognition Naturally occurring Cas9 molecules can recognize specific PAM sequences, for example, the PAM recognition sequences described above for *S. pyogenes, S. thermophilus, S. mutans, S. aureus* and *N. meningitidis*.

In an embodiment, a Cas9 molecule or Cas9 polypeptide has the same PAM specificities as a naturally occurring Cas9 molecule. In other embodiments, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule recognizes to decrease off target sites and/or improve specificity; or eliminate a PAM recognition requirement. In an embodiment, a Cas9 molecule or Cas9 polypeptide can be altered, e.g., to increase length of PAM recognition sequence and/or improve Cas9 specificity to high level of identity, e.g., to decrease off target sites and increase specificity. In an embodiment, the length of the PAM recognition sequence is at least 4, 5, 6, 7, 8, 9, 10 or 15 amino acids in length. Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt et al. NATURE 2011, 472(7344): 499-503. Candidate Cas9 molecules can be evaluated, e.g., by methods described in Section IV.

Alterations of the PI Domain, which Mediates PAM Recognition, are Discussed Below.

Synthetic Cas9 Molecules and Cas9 Polypeptides with Altered PI Domains Current genome-editing methods are limited in the diversity of target sequences that can be targeted by the PAM sequence that is recognized by the Cas9 molecule utilized. A synthetic Cas9 molecule (or Syn-Cas9 molecule), or synthetic Cas9 polypeptide (or Syn-Cas9 polypeptide), as that term is used herein, refers to a Cas9 molecule or Cas9 polypeptide that comprises a Cas9 core domain from one bacterial species and a functional altered PI domain, i.e., a PI domain other than that naturally associated with the Cas9 core domain, e.g., from a different bacterial species.

In an embodiment, the altered PI domain recognizes a PAM sequence that is different from the PAM sequence recognized by the naturally-occurring Cas9 from which the Cas9 core domain is derived. In an embodiment, the altered PI domain recognizes the same PAM sequence recognized by the naturally-occurring Cas9 from which the Cas9 core domain is derived, but with different affinity or specificity. A Syn-Cas9 molecule or Syn-Cas9 polypeptide can be, respectively, a Syn-eaCas9 molecule or Syn-eaCas9 polypeptide or a Syn-eiCas9 molecule Syn-eiCas9 polypeptide.

An exemplary Syn-Cas9 molecule or Syn-Cas9 polypeptide comprises:

a) a Cas9 core domain, e.g., a Cas9 core domain from Table 11 or 12, e.g., a *S. aureus, S. pyogenes,* or *C. jejuni* Cas9 core domain; and b) an altered PI domain from a species X Cas9 sequence selected from Tables 14 and 15.

In an embodiment, the RKR motif (the PAM binding motif) of said altered PI domain comprises: differences at 1, 2, or 3 amino acid residues; a difference in amino acid sequence at the first, second, or third position; differences in amino acid sequence at the first and second positions, the first and third positions, or the second and third positions; as compared with the sequence of the RKR motif of the native or endogenous PI domain associated with the Cas9 core domain.

In an embodiment, the Cas9 core domain comprises the Cas9 core domain from a species X Cas9 from Table 11 and said altered PI domain comprises a PI domain from a species Y Cas9 from Table 11.

In an embodiment, the RKR motif of the species X Cas9 is other than the RKR motif of the species Y Cas9.

In an embodiment, the RKR motif of the altered PI domain is selected from XXY, XNG, and XNQ.

In an embodiment, the altered PI domain has at least 60, 70, 80, 90, 95, or 100% homology with the amino acid sequence of a naturally occurring PI domain of said species Y from Table 11.

In an embodiment, the altered PI domain differs by no more than 50, 40, 30, 25, 20, 15, 10, 5, 4, 3, 2, or 1 amino acid residue from the amino acid sequence of a naturally occurring PI domain of said second species from Table 11.

In an embodiment, the Cas9 core domain comprises a *S. aureus* core domain and altered PI domain comprises: an *A. denitrificans* PI domain; a *C. jejuni* PI domain; a *H. mustelae* PI domain; or an altered PI domain of species X PI domain, wherein species X is selected from Table 15.

In an embodiment, the Cas9 core domain comprises a *S. pyogenes* core domain and the altered PI domain comprises: an *A. denitrificans* PI domain; a *C. jejuni* PI domain; a *H. mustelae* PI domain; or an altered PI domain of species X PI domain, wherein species X is selected from Table 15.

In an embodiment, the Cas9 core domain comprises a *C. jejuni* core domain and the altered PI domain comprises: an *A. denitrificans* PI domain; a *H. mustelae* PI domain; or an altered PI domain of species X PI domain, wherein species X is selected from Table 15.

In an embodiment, the Cas9 molecule or Cas9 polypeptide further comprises a linker disposed between said Cas9 core domain and said altered PI domain.

In an embodiment, the linker comprises: a linker described elsewhere herein disposed between the Cas9 core domain and the heterologous PI domain. Suitable linkers are further described in Section V.

Exemplary altered PI domains for use in Syn-Cas9 molecules are described in Tables 14 and 15. The sequences for the 83 Cas9 orthologs referenced in Tables 14 and 15 are provided in Table 11. Table 13 provides the Cas9 orthologs with known PAM sequences and the corresponding RKR motif.

In an embodiment, a Syn-Cas9 molecule or Syn-Cas9 polypeptide may also be size-optimized, e.g., the Syn-Cas9 molecule or Syn-Cas9 polypeptide comprises one or more deletions, and optionally one or more linkers disposed between the amino acid residues flanking the deletions. In an embodiment, a Syn-Cas9 molecule or Syn-Cas9 polypeptide comprises a REC deletion.

Size-Optimized Cas9 Molecules and Cas9 Polypeptides

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a *S. aureus*, *S. pyogenes*, or *C. jejuni*, Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule or Cas9 polypeptide can comprise one or more deletions that do not substantially affect or decrease the activity of the resultant Cas9 molecules or Cas9 polypeptides described herein. Activities that are retained in the Cas9 molecules or Cas9 polypeptides comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules or Cas9 polypeptides described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed in Table 11, can be modeled onto the crystal structure of *S. pyogenes* Cas9 (Nishimasu et al., Cell, 156:935-949, 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

REC-Optimized Cas9 Molecules and Cas9 Polypeptides

A REC-optimized Cas9 molecule, or a REC-optimized Cas9 polypeptide, as that term is used herein, refers to a Cas9 molecule or Cas9 polypeptide that comprises a deletion in one or both of the REC2 domain and the RE1 $C_T$ domain (collectively a REC deletion), wherein the deletion comprises at least 10% of the amino acid residues in the cognate domain. A REC-optimized Cas9 molecule or Cas9 polypeptide can be an eaCas9 molecule or eaCas9 polypeptide, or an eiCas9 molecule or eiCas9 polypeptide. An exemplary REC-optimized Cas9 molecule or REC-optimized Cas9 polypeptide comprises:

a) a deletion selected from:
i) a REC2 deletion;
ii) a REC1$_{CT}$ deletion; or
iii) a REC1$_{SUB}$ deletion.

Optionally, a linker is disposed between the amino acid residues that flank the deletion. In an embodiment, a Cas9 molecule or Cas9 polypeptide includes only one deletion, or only two deletions. A Cas9 molecule or Cas9 polypeptide can comprise a REC2 deletion and a REC1$_{CT}$ deletion. A Cas9 molecule or Cas9 polypeptide can comprise a REC2 deletion and a REC1$_{SUB}$ deletion.

Generally, the deletion will contain at least 10% of the amino acids in the cognate domain, e.g., a REC2 deletion will include at least 10% of the amino acids in the REC2 domain.

A deletion can comprise: at least 10, 20, 30, 40, 50, 60, 70, 80, or 90% of the amino acid residues of its cognate domain; all of the amino acid residues of its cognate domain; an amino acid residue outside its cognate domain; a plurality of amino acid residues outside its cognate domain; the amino acid residue immediately N terminal to its cognate domain; the amino acid residue immediately C terminal to its cognate domain; the amino acid residue immediately N terminal to its cognate and the amino acid residue immediately C terminal to its cognate domain; a plurality of, e.g., up to 5, 10, 15, or 20, amino acid residues N terminal to its cognate domain; a plurality of, e.g., up to 5, 10, 15, or 20, amino acid residues C terminal to its cognate domain; a plurality of, e.g., up to 5, 10, 15, or 20, amino acid residues N terminal to its cognate domain and a plurality of e.g., up to 5, 10, 15, or 20, amino acid residues C terminal to its cognate domain.

In an embodiment, a deletion does not extend beyond: its cognate domain; the N terminal amino acid residue of its cognate domain; the C terminal amino acid residue of its cognate domain.

A REC-optimized Cas9 molecule or REC-optimized Cas9 polypeptide can include a linker disposed between the amino acid residues that flank the deletion. Suitable linkers for use between the amino acid resides that flank a REC deletion in a REC-optimized Cas9 molecule or REC-optimized Cas9 polypeptide is disclosed in Section V.

In an embodiment, a REC-optimized Cas9 molecule or REC-optimized Cas9 polypeptide comprises an amino acid sequence that, other than any REC deletion and associated linker, has at least 50, 55, 60, 65, 70, 75, 80, 85, 90, 95, 99, or 100% homology with the amino acid sequence of a naturally occurring Cas 9, e.g., a Cas9 molecule described in Table 11, e.g., a *S. aureus* Cas9 molecule, a *S. pyogenes* Cas9 molecule, or a *C. jejuni* Cas9 molecule.

In an embodiment, a a REC-optimized Cas9 molecule or REC-optimized Cas9 polypeptide comprises an amino acid sequence that, other than any REC deletion and associated linker, differs by no more than 1, 2, 3, 4, 5, 6, 7, 8, 9, 10, 15, 20, or 25, amino acid residues from the amino acid sequence of a naturally occurring Cas 9, e.g., a Cas9 molecule described in Table 11, e.g., a S. aureus Cas9 molecule, a S. pyogenes Cas9 molecule, or a C. jejuni Cas9 molecule.

In an embodiment, a REC-optimized Cas9 molecule or REC-optimized Cas9 polypeptide comprises an amino acid sequence that, other than any REC deletion and associate linker, differs by no more than 1, 2, 3, 4, 5, 6, 7, 8, 9, 10, 15, 20, or 25% of the, amino acid residues from the amino acid sequence of a naturally occurring Cas 9, e.g., a Cas9 molecule described in Table 11, e.g., a S. aureus Cas9 molecule, a S. pyogenes Cas9 molecule, or a C. jejuni Cas9 molecule.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

Sequence information for exemplary REC deletions are provided for 83 naturally-occurring Cas9 orthologs in Table 11.

The amino acid sequences of exemplary Cas9 molecules from different bacterial species are shown below.

TABLE 11

Amino Acid Sequence of Cas9 Orthologs

| Species/Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| Staphylococcus Aureus tr\|JTRUA5\|J7RUA5_STAAU | SEQ ID NO: 304 | 126 | 166 | 41 | 296 | 352 | 57 | 296 | 352 | 57 |
| Streptococcus Pyogenes sp\|Q99ZW2\|CAS9_STRP1 | SEQ ID NO: 305 | 176 | 314 | 139 | 511 | 592 | 82 | 511 | 592 | 82 |
| Campylobacter jejuni NCTC 11168 gi\|218563121\|ref\|YP_002344900.1 | SEQ ID NO: 306 | 137 | 181 | 45 | 316 | 360 | 45 | 316 | 360 | 45 |
| Bacteroides fragilis NCTC 9343 gi\|60683389\|ref\|YP_213533.1\| | SEQ ID NO: 307 | 148 | 339 | 192 | 524 | 617 | 84 | 524 | 617 | 84 |
| Bifidobacterium bifidum S17 gi\|310286728\|ref\|YP_003937986. | SEQ ID NO: 308 | 173 | 335 | 163 | 516 | 607 | 87 | 516 | 607 | 87 |
| Veillonella atypica ACS-134-V-Col7a gi\|303229466\|ref\|ZP_07316256.1 | SEQ ID NO: 309 | 185 | 339 | 155 | 574 | 663 | 79 | 574 | 663 | 79 |
| Lactobacillus rhamnosus GG gi\|258509199\|ref\|YP_003171950.1 | SEQ ID NO: 310 | 169 | 320 | 152 | 559 | 645 | 78 | 559 | 645 | 78 |
| Filifactor alocis ATCC 35896 gi\|374307738\|ref\|YP_005054169.1 | SEQ ID NO: 311 | 166 | 314 | 149 | 508 | 592 | 76 | 508 | 592 | 76 |
| Oenococcus kitaharae DSM 17330 gi\|366983953\|gb\|EHN59352.1\| | SEQ ID NO: 312 | 169 | 317 | 149 | 555 | 639 | 80 | 555 | 639 | 80 |
| Fructobacillus fructosus KCTC 3544 gi\|339625081\|ref\|ZP_08660870.1 | SEQ ID NO: 313 | 168 | 314 | 147 | 488 | 571 | 76 | 488 | 571 | 76 |
| Catenibacterium mitsuokai DSM 15897 gi\|224543312\|ref\|ZP_03683851.1 | SEQ ID NO: 314 | 173 | 318 | 146 | 511 | 594 | 78 | 511 | 594 | 78 |
| Finegoldia magna ATCC 29328 gi\|169823755\|ref\|YP_001691366.1 | SEQ ID NO: 315 | 168 | 313 | 146 | 452 | 534 | 77 | 452 | 534 | 77 |
| CoriobacteriumglomeransPW2 gi\|328956315\|ref\|YP_004373648.1 | SEQ ID NO: 316 | 175 | 318 | 144 | 511 | 592 | 82 | 511 | 592 | 82 |
| Eubacterium yurii ATCC 43715 gi\|306821691\|ref\|ZP_07455288.1 | SEQ ID NO: 317 | 169 | 310 | 142 | 552 | 633 | 76 | 552 | 633 | 76 |
| Peptoniphilus duerdenii ATCC BAA-1640 gi\|304438954\|ref\|ZP_07398877.1 | SEQ ID NO: 318 | 171 | 311 | 141 | 535 | 615 | 76 | 535 | 615 | 76 |

TABLE 11-continued

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| Acidaminococcus sp. D21 gi\|227824983\|ref\|ZP_03989815.1 | SEQ ID NO: 319 | 167 | 306 | 140 | 511 | 591 | 75 | 511 | 591 | 75 |
| Lactobacillus farciminis KCTC 3681 gi\|336394882\|ref\|ZP_08576281.1 | SEQ ID NO: 320 | 171 | 310 | 140 | 542 | 621 | 85 | 542 | 621 | 85 |
| Streptococcus sanguinis SK49 gi\|422884106\|ref\|ZP_16930555.1 | SEQ ID NO: 321 | 185 | 324 | 140 | 411 | 490 | 85 | 411 | 490 | 85 |
| Coprococcus catus GD-7 gi\|291520705\|emb\|CBK78998.1\| | SEQ ID NO: 322 | 172 | 310 | 139 | 556 | 634 | 76 | 556 | 634 | 76 |
| Streptococcus mutans UA159 gi\|24379809\|ref\|NP_721764.1\| | SEQ ID NO: 323 | 176 | 314 | 139 | 392 | 470 | 84 | 392 | 470 | 84 |
| Streptococcus pyogenes M1 GAS gi\|13622193\|gb\|AAK33936.1\| | SEQ ID NO: 324 | 176 | 314 | 139 | 523 | 600 | 82 | 523 | 600 | 82 |
| Streptococcus thermophilus LMD-9 gi\|116628213\|ref\|YP_820832.1\| | SEQ ID NO: 325 | 176 | 314 | 139 | 481 | 558 | 81 | 481 | 558 | 81 |
| Fusobacteriumnucleatum ATCC49256 gi\|34762592\|ref\|ZP_00143587.1\| | SEQ ID NO: 326 | 171 | 308 | 138 | 537 | 614 | 76 | 537 | 614 | 76 |
| Planococcus antarcticus DSM 14505 gi\|389815359\|ref\|ZP_10206685.1 | SEQ ID NO: 327 | 162 | 299 | 138 | 538 | 614 | 94 | 538 | 614 | 94 |
| Treponema denticola ATCC 35405 gi\|42525843\|ref\|NP_970941.1\| | SEQ ID NO: 328 | 169 | 305 | 137 | 524 | 600 | 81 | 524 | 600 | 81 |
| Solobacterium moorei F0204 gi\|320528778\|ref\|ZP_08029929.1 | SEQ ID NO: 329 | 179 | 314 | 136 | 544 | 619 | 77 | 544 | 619 | 77 |
| Staphylococcus pseudintermedius ED99 gi\|323463801\|gb\|ADX75954.1\| | SEQ ID NO: 330 | 164 | 299 | 136 | 531 | 606 | 92 | 531 | 606 | 92 |
| Flavobacterium branchiophilum FL-15 gi\|347536497\|ref\|YP_004843922.1 | SEQ ID NO: 331 | 162 | 286 | 125 | 538 | 613 | 63 | 538 | 613 | 63 |
| Ignavibacterium album JCM 16511 gi\|385811609\|ref\|YP_005848005.1 | SEQ ID NO: 332 | 223 | 329 | 107 | 357 | 432 | 90 | 357 | 432 | 90 |
| Bergeyella zoohelcum ATCC 43767 gi\|423317190\|ref\|ZP_17295095.1 | SEQ ID NO: 333 | 165 | 261 | 97 | 529 | 604 | 56 | 529 | 604 | 56 |
| Nitrobacter hamburgensis X14 gi\|92109262\|ref\|YP_571550.1\| | SEQ ID NO: 334 | 169 | 253 | 85 | 536 | 611 | 48 | 536 | 611 | 48 |
| Odoribacter laneus YIT 12061 gi\|374384763\|ref\|ZP_09642280.1 | SEQ ID NO: 335 | 164 | 242 | 79 | 535 | 610 | 63 | 535 | 610 | 63 |
| Legionella pneumophila str. Paris gi\|54296138\|ref\|YP_122507.1\| | SEQ ID NO: 336 | 164 | 239 | 76 | 402 | 476 | 67 | 402 | 476 | 67 |
| Bacteroides sp. 20 3 gi\|301311869\|ref\|ZP_07217791.1 | SEQ ID NO: 337 | 198 | 269 | 72 | 530 | 604 | 83 | 530 | 604 | 83 |
| Akkermansia muciniphila ATCC BAA-835 gi\|187736489\|ref\|YP_001878601. | SEQ ID NO: 338 | 136 | 202 | 67 | 348 | 418 | 62 | 348 | 418 | 62 |
| Prevotella sp. C561 gi\|345885718\|ref\|ZP_08837074.1 | SEQ ID NO: 339 | 184 | 250 | 67 | 357 | 425 | 78 | 357 | 425 | 78 |
| Wolinella succinogenes DSM 1740 gi\|34557932\|ref\|NP_907747.1\| | SEQ ID NO: 340 | 157 | 218 | 36 | 401 | 468 | 60 | 401 | 468 | 60 |
| Alicyclobacillus hesperidum URH17-3-68 gi\|403744858\|ref\|ZP_10953934.1 | SEQ ID NO: 341 | 142 | 196 | 55 | 416 | 482 | 61 | 416 | 482 | 61 |
| Caenispirillum salinarum AK4 gi\|427429481\|ref\|ZP_18919511.1 | SEQ ID NO: 342 | 161 | 214 | 54 | 330 | 393 | 68 | 330 | 393 | 68 |
| Eubacterium rectale ATCC 33656 gi\|238924075\|ref\|YP_002937591.1 | SEQ ID NO: 343 | 133 | 185 | 53 | 322 | 384 | 60 | 322 | 384 | 60 |
| Mycoplasma synoviae 53 gi\|71894592\|ref\|YP_278700.1\| | SEQ ID NO: 344 | 187 | 239 | 53 | 319 | 381 | 80 | 319 | 381 | 80 |
| Porphyromonas sp. oral taxon 279 str. F0450 gi\|402847315\|ref\|ZP_10895610.1 | SEQ ID NO: 345 | 150 | 202 | 53 | 309 | 371 | 60 | 309 | 371 | 60 |
| Streptococcus thermophilus LMD-9 gi\|116627542\|ref\|YP_820161.1\| | SEQ ID NO: 346 | 127 | 178 | 139 | 424 | 486 | 81 | 424 | 486 | 81 |
| Roseburia inulinivorans DSM 16841 gi\|225377804\|ref\|ZP_03755025.1 | SEQ ID NO: 347 | 154 | 204 | 51 | 318 | 380 | 69 | 318 | 380 | 69 |
| Methylosinus trichosporium OB3b gi\|296446027\|ref\|ZP_06887976.1 | SEQ ID NO: 348 | 144 | 193 | 50 | 426 | 488 | 64 | 426 | 488 | 64 |
| Ruminococcus albus 8 gi\|325677756\|ref\|ZP_08157403.1 | SEQ ID NO: 349 | 139 | 187 | 49 | 351 | 412 | 55 | 351 | 412 | 55 |
| Bifidobacterium longum DJO10A gi\|189440764\|ref\|YP_001955845. | SEQ ID NO: 350 | 183 | 230 | 48 | 370 | 431 | 44 | 370 | 431 | 44 |
| Enterococcus faecalis TX0012 gi\|315149830\|gb\|EFT93846.1\| | SEQ ID NO: 351 | 123 | 170 | 48 | 327 | 387 | 60 | 327 | 387 | 60 |
| Mycoplasma mobile 163K gi\|47458868\|ref\|YP_015730.1\| | SEQ ID NO: 352 | 179 | 226 | 48 | 314 | 374 | 79 | 314 | 374 | 79 |
| Actinomyces coleocanis DSM 15436 gi\|227494853\|ref\|ZP_03925169.1 | SEQ ID NO: 353 | 147 | 193 | 47 | 358 | 418 | 40 | 358 | 418 | 40 |

TABLE 11-continued

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| Dinoroseobacter shibae DFL 12 gi\|159042956\|ref\|YP_001531750.1 | SEQ ID NO: 354 | 138 | 184 | 47 | 338 | 398 | 48 | 338 | 398 | 48 |
| Actinomyces sp. oral taxon 180 str. F0310 gi\|315605738\|ref\|ZP_07880770.1 | SEQ ID NO: 355 | 183 | 228 | 46 | 349 | 409 | 40 | 349 | 409 | 40 |
| Alcanivorax sp. W11-5 gi\|407803669\|ref\|ZP_11150502.1 | SEQ ID NO: 356 | 139 | 183 | 45 | 344 | 404 | 61 | 344 | 404 | 61 |
| Aminomonas paucivorans DSM 12260 gi\|312879015\|ref\|ZP_07738815.1 | SEQ ID NO: 357 | 134 | 178 | 45 | 341 | 401 | 63 | 341 | 401 | 63 |
| Mycoplasma canis PG 14 gi\|384393286\|gb\|EIE39736.1\| | SEQ ID NO: 358 | 139 | 183 | 45 | 319 | 379 | 76 | 319 | 379 | 76 |
| Lactobacillus coryniformis KCTC 3535 gi\|336393381\|ref\|ZP_08574780.1 | SEQ ID NO: 359 | 141 | 184 | 44 | 328 | 387 | 61 | 328 | 387 | 61 |
| Elusimicrobium minutum Pei191 gi\|187250660\|ref\|YP_001875142.1 | SEQ ID NO: 360 | 177 | 219 | 43 | 322 | 381 | 47 | 322 | 381 | 47 |
| Neisseria meningitidis Z2491 gi\|218767588\|ref\|YP_002342100.1 | SEQ ID NO: 361 | 147 | 189 | 43 | 360 | 419 | 61 | 360 | 419 | 61 |
| Pasteurella multocida str. Pm70 gi\|15602992\|ref\|NP_246064.1\| | SEQ ID NO: 362 | 139 | 181 | 43 | 319 | 378 | 61 | 319 | 378 | 61 |
| Rhodovulum sp. PH10 gi\|402849997\|ref\|ZP_10898214.1 | SEQ ID NO: 363 | 141 | 183 | 43 | 319 | 378 | 48 | 319 | 378 | 48 |
| Eubacterium dolichum DSM 3991 gi\|160915782\|ref\|ZP_02077990.1 | SEQ ID NO: 364 | 131 | 172 | 42 | 303 | 361 | 59 | 303 | 361 | 59 |
| Nitratifractor salsuginis DSM 16511 gi\|319957206\|ref\|YP_004168469.1 | SEQ ID NO: 365 | 143 | 184 | 42 | 347 | 404 | 61 | 347 | 404 | 61 |
| Rhodospirillum rubrum ATCC 11170 gi\|83591793\|ref\|YP_425545.1\| | SEQ ID NO: 366 | 139 | 180 | 42 | 314 | 371 | 55 | 314 | 371 | 55 |
| Clostridium cellulolyticum H10 gi\|220930482\|ref\|YP_002507391.1 | SEQ ID NO: 367 | 137 | 176 | 40 | 320 | 376 | 61 | 320 | 376 | 61 |
| Helicobacter mustelae 12198 gi\|291276265\|ref\|YP_003516037.1 | SEQ ID NO: 368 | 148 | 187 | 40 | 298 | 354 | 48 | 298 | 354 | 48 |
| Ilyobacter polytropus DSM 2926 gi\|310780384\|ref\|YP_003968716.1 | SEQ ID NO: 369 | 134 | 173 | 40 | 462 | 517 | 63 | 462 | 517 | 63 |
| Sphaerochaeta globus str. Buddy gi\|325972003\|ref\|YP_004248194.1 | SEQ ID NO: 370 | 163 | 202 | 40 | 335 | 389 | 45 | 335 | 389 | 45 |
| Staphylococcus lugdunensis M23590 gi\|315659848\|ref\|ZP_07912707.1 | SEQ ID NO: 371 | 128 | 167 | 40 | 337 | 391 | 57 | 337 | 391 | 57 |
| Treponema sp. JC4 gi\|384109266\|ref\|ZP_10010146.1 | SEQ ID NO: 372 | 144 | 183 | 40 | 328 | 382 | 63 | 328 | 382 | 63 |
| uncultured delta proteobacterium HF0070 07E19 gi\|297182908\|gb\|ADI19058.1\| | SEQ ID NO: 373 | 154 | 193 | 40 | 313 | 365 | 55 | 313 | 365 | 55 |
| Alicycliphilus denitrificans K601 gi\|330822845\|ref\|YP_004386148.1 | SEQ ID NO: 374 | 140 | 178 | 39 | 317 | 366 | 48 | 317 | 366 | 48 |
| Azospirillum sp. B510 gi\|288957741\|ref\|YP_003448082.1 | SEQ ID NO: 375 | 205 | 243 | 39 | 342 | 389 | 46 | 342 | 389 | 46 |
| Bradyrhizobium sp. BTAi1 gi\|148255343\|ref\|YP001239928.1 | SEQ ID NO: 376 | 143 | 181 | 39 | 323 | 370 | 48 | 323 | 370 | 48 |
| Parvibaculum lavamentivorans DS-1 gi\|154250555\|ref\|YP_001411379.1 | SEQ ID NO: 377 | 138 | 176 | 39 | 327 | 374 | 58 | 327 | 374 | 58 |
| Prevotella timonensis CRIS 5C-B1 gi\|282880052\|ref\|ZP_06288774.1 | SEQ ID NO: 378 | 170 | 208 | 39 | 328 | 375 | 61 | 328 | 375 | 61 |
| Bacillus smithii 7 3 47FAA gi\|365156657\|ref\|ZP_09352959.1 | SEQ ID NO: 379 | 134 | 171 | 38 | 401 | 448 | 63 | 401 | 448 | 63 |
| Cand. Puniceispirillum marinum IMCC1322 gi\|294086111\|ref\|YP_003552871.1 | SEQ ID NO: 380 | 135 | 172 | 38 | 344 | 391 | 53 | 344 | 391 | 53 |
| Barnesiella intestinihominis YIT 11860 gi\|404487228\|ref\|ZP_l 1022414.1 | SEQ ID NO: 381 | 140 | 176 | 37 | 371 | 417 | 60 | 371 | 417 | 60 |
| Ralstonia syzygii R24 gi\|344171927\|emb\|CCA84553.1\| | SEQ ID NO: 382 | 140 | 176 | 37 | 395 | 440 | 50 | 395 | 440 | 50 |
| Wolinella succinogenes DSM 1740 gi\|34557790\|ref\|NP_907605.1\| | SEQ ID NO: 383 | 145 | 180 | 36 | 348 | 392 | 60 | 348 | 392 | 60 |
| Mycoplasma gallisepticum str. F gi\|284931710\|gb\|ADC31648.1\| | SEQ ID NO: 384 | 144 | 177 | 34 | 373 | 416 | 71 | 373 | 416 | 71 |
| Acidothermus cellulolyticus 11B gi\|117929158\|ref\|YP_873709.1\| | SEQ ID NO: 385 | 150 | 182 | 33 | 341 | 380 | 58 | 341 | 380 | 58 |
| Mycoplasma ovipneumoniae SC01 gi\|363542550\|ref\|ZP_09312133.1 | SEQ ID NO: 386 | 156 | 184 | 29 | 381 | 420 | 62 | 381 | 420 | 62 |

TABLE 12

Amino Acid Sequence of Cas9 Core Domains

| Strain Name | Cas9 Start (AA pos) Start and Stop numbers refer to the sequence in Table 11 | Cas9 Stop (AA pos) |
|---|---|---|
| Staphylococcus Aureus | 1 | 772 |
| Streptococcus Pyogenes | 1 | 1099 |
| Campulobacter Jejuni | 1 | 741 |

TABLE 13

Identified PAM sequences and corresponding RKR motifs.

| Strain Name | PAM sequence (NA) | RKR motif (AA) |
|---|---|---|
| Streptococcus pyogenes | NGG | RKR |
| Streptococcus mutans | NGG | RKR |
| Streptococcus thermophilus A | NGGNG | RYR |
| Treponema denticola | NAAAAN | VAK |
| Streptococcus thermophilus B | NNAAAAW | IYK |
| Campylobacter jejuni | NNNNACA | NLK |
| Pasteurella multocida | GNNNCNNA | KDG |
| Neisseria meningitidis | NNNNGATT or | IGK |
| Staphylococcus aureus | NNGRRV (R = A or G; V = A. G or C) NNGRRT (R = A or G) | NDK |

PI domains are provided in Tables 14 and 15.

TABLE 14

Altered PI Domains

| Strain Name | PI Start (AA pos) Start and Stop numbers refer to the sequences in Table 100 | PI Stop (AA pos) | Length of PI (AA) | RKR motif (AA) |
|---|---|---|---|---|
| Alicycliphilus denitrificans K601 | 837 | 1029 | 193 | --Y |
| Campylobacter jejuni NCTC 11168 | 741 | 984 | 244 | -NG |
| Helicobacter mustelae 12198 | 771 | 1024 | 254 | -NQ |

TABLE 15

Other Altered PI Domains

| Strain Name | PI Start (AA pos) Start and Stop numbers refer to the sequences in Table 11 | PI Stop (AA pos) | Length of PI (AA) | RKR motif (AA) |
|---|---|---|---|---|
| Akkermansia muciniphila ATCC BAA-835 | 871 | 1101 | 231 | ALK |
| Ralstonia syzygii R24 | 821 | 1062 | 242 | APY |
| Cand. Puniceispirillum marinum IMCC1322 | 815 | 1035 | 221 | AYK |
| Fructobacillus fructosus KCTC 3544 | 1074 | 1323 | 250 | DGN |
| Eubacterium yurii ATCC 43715 | 1107 | 1391 | 285 | DGY |
| Eubacterium dolichum DSM 3991 | 779 | 1096 | 318 | DKK |
| Dinoroseobacter shibae DFL 12 | 851 | 1079 | 229 | DPI |
| Clostridium cellulolyticum H10 | 767 | 1021 | 255 | EGK |
| Pasteurella multocida str. Pm70 | 815 | 1056 | 242 | ENN |
| Mycoplasma canis PG 14 | 907 | 1233 | 327 | EPK |
| Porphyromonas sp. oral taxon 279 str. F0450 | 935 | 1197 | 263 | EPT |
| Filifactor alocis ATCC 35896 | 1094 | 1365 | 272 | EVD |
| Aminomonas paucivorans DSM 12260 | 801 | 1052 | 252 | EVY |
| Wolinella succinogenes DSM 1740 | 1034 | 1409 | 376 | EYK |
| Oenococcus kitaharae DSM 17330 | 1119 | 1389 | 271 | GAL |
| Coriobacteriumglomerans PW2 | 1126 | 1384 | 259 | GDR |
| Peptoniphilus duerdenii ATCC BAA-1640 | 1091 | 1364 | 274 | GDS |
| Bifidobacterium bifidum S17 | 1138 | 1420 | 283 | GGL |
| Alicyclobacillus hesperidum URH17-3-68 | 876 | 1146 | 271 | GGR |
| Roseburia inulinivorans DSM 16841 | 895 | 1152 | 258 | GGT |
| Actinomyces coleocanis DSM 15436 | 843 | 1105 | 263 | GKK |
| Odoribacter laneus YIT 12061 | 1103 | 1498 | 396 | GKV |
| Coprococcus catus GD-7 | 1063 | 1338 | 276 | GNQ |
| Enterococcus faecalis TX0012 | 829 | 1150 | 322 | GRK |

TABLE 15-continued

Other Altered PI Domains

| Strain Name | PI Start (AA pos) Start and Stop numbers refer to the sequences in Table 11 | PI Stop (AA pos) | Length of PI (AA) | RKR motif (AA) |
|---|---|---|---|---|
| *Bacillus smithii* 7 3 47FAA | 809 | 1088 | 280 | GSK |
| *Legionella pneumophila* str. Paris | 1021 | 1372 | 352 | GTM |
| *Bacteroides fragilis* NCTC 9343 | 1140 | 1436 | 297 | IPV |
| *Mycoplasma ovipneumoniae* SC01 | 923 | 1265 | 343 | IRI |
| *Actinomyces* sp. oral taxon 180 str. F0310 | 895 | 1181 | 287 | KEK |
| *Treponema* sp. JC4 | 832 | 1062 | 231 | KIS |
| *Fusobacterium nucleatum* ATCC49256 | 1073 | 1374 | 302 | KKV |
| *Lactobacillus farciminis* KCTC 3681 | 1101 | 1356 | 256 | KKV |
| *Nitratifractor salsuginis* DSM 16511 | 840 | 1132 | 293 | KMR |
| *Lactobacillus coryniformis* KCTC 3535 | 850 | 1119 | 270 | KNK |
| *Mycoplasma mobile* 163K | 916 | 1236 | 321 | KNY |
| *Flavobacterium branchiophilum* FL-15 | 1182 | 1473 | 292 | KQK |
| *Prevotella timonensis* CRIS 5C-B1 | 957 | 1218 | 262 | KQQ |
| *Methylosinus trichosporium* OB3b | 830 | 1082 | 253 | KRP |
| *Prevotella* sp. C561 | 1099 | 1424 | 326 | KRY |
| *Mycoplasma gallisepticum* str. F | 911 | 1269 | 359 | KTA |
| *Lactobacillus rhamnosus* GG | 1077 | 1363 | 287 | KYG |
| *Wolinella succinogenes* DSM 1740 | 811 | 1059 | 249 | LPN |
| *Streptococcus thermophilus* LMD-9 | 1099 | 1388 | 290 | MLA |
| *Treponema denticola* ATCC 35405 | 1092 | 1395 | 304 | NDS |
| *Bergeyella zoohelcum* ATCC 43767 | 1098 | 1415 | 318 | NEK |
| *Veillonella atypica* ACS-134-V-Col7a | 1107 | 1398 | 292 | NGF |
| *Neisseria meningitidis* Z2491 | 835 | 1082 | 248 | NHN |
| *Ignavibacterium album* JCM 16511 | 1296 | 1688 | 393 | NKK |
| *Ruminococcus albus* 8 | 853 | 1156 | 304 | NNF |
| *Streptococcus thermophilus* LMD-9 | 811 | 1121 | 311 | NNK |
| *Barnesiella intestinihominis* YIT 11860 | 871 | 1153 | 283 | NPV |
| *Azospirillum* sp. B510 | 911 | 1168 | 258 | PFH |
| *Rhodospirillum rubrum* ATCC 11170 | 863 | 1173 | 311 | PRG |
| *Planococcus antarcticus* DSM 14505 | 1087 | 1333 | 247 | PYY |
| *Staphylococcus pseudintermedius* ED99 | 1073 | 1334 | 262 | QIV |
| *Alcanivorax* sp. W11-5 | 843 | 1113 | 271 | RIE |
| *Bradyrhizobium* sp. BTAi1 | 811 | 1064 | 254 | RIY |
| *Streptococcus pyogenes* M1 GAS | 1099 | 1368 | 270 | RKR |
| *Streptococcus mutans* UA159 | 1078 | 1345 | 268 | RKR |
| *Streptococcus Pyogenes* | 1099 | 1368 | 270 | RKR |
| *Bacteroides* sp. 20 3 | 1147 | 1517 | 371 | RNI |
| *S. aureus* | 772 | 1053 | 282 | RNK |
| *Solobacterium moorei* F0204 | 1062 | 1327 | 266 | RSG |
| *Finegoldia magna* ATCC 29328 | 1081 | 1348 | 268 | RTE |
| uncultured delta *proteobacterium* HF0070 07E19 | 770 | 1011 | 242 | SGG |
| *Acidaminococcus* sp. D21 | 1064 | 1358 | 295 | SIG |
| *Eubacterium rectale* ATCC 33656 | 824 | 1114 | 291 | SKK |
| *Caenispirillum salinarum* AK4 | 1048 | 1442 | 395 | SLV |
| *Acidothermus cellulolyticus* 11B | 830 | 1138 | 309 | SPS |
| *Catenibacterium mitsuokai* DSM 15897 | 1068 | 1329 | 262 | SPT |
| *Parvibaculum lavamentivorans* DS-1 | 827 | 1037 | 211 | TGN |
| *Staphylococcus lugdunensis* M23590 | 772 | 1054 | 283 | TKK |
| *Streptococcus sanguinis* SK49 | 1123 | 1421 | 299 | TRM |
| *Elusimicrobium minutum* Pei191 | 910 | 1195 | 286 | TTG |
| *Nitrobacter hamburgensis* X14 | 914 | 1166 | 253 | VAY |
| *Mycoplasma synoviae* 53 | 991 | 1314 | 324 | VGF |
| *Sphaerochaeta globus* str. Buddy | 877 | 1179 | 303 | VKG |
| *Ilyobacter polytropus* DSM 2926 | 837 | 1092 | 256 | VNG |
| *Rhodovulum* sp. PH10 | 821 | 1059 | 239 | VPY |
| *Bifidobacterium longum* DJO10A | 904 | 1187 | 284 | VRK |

Amino Acid Sequences Described in Table 11 (in Order of Appearance):

SEQ ID NO: 304

MKRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLMGHCTYFPEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIIRTTGKENAKYLIEKIKLHDMQEGKCLYSLEAIPLEDLLNNP
FNYEVDHIIPRSVSFDNSFNNKVLVKQEENSKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIFKEWKKLDKAKKVMENQMFEEKQAESMPEIETEQEY
KEIFITPHQIKHIKDFKDYKYSHRVDKKPNRELINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
RNKVVKLSLKPYRFDVYLDNGVYKFVTVKNLDVIKKENYYEVNSKCYEEA
KKLKKISNQAEFIASFYNNDLIKINGELYRVIGVNNDLLNRIEVNMIDIT
YREYLENMNDKRPPRIIKTIASKTQSIKKYSTDILGNLYEVKSKKHPQII
KKG

SEQ ID NO: 305

MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDGSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD

SEQ ID NO: 306

MARILAFDIGISSIGWAFSENDELKDCGVRIFTKVENPKTGESLALPRRL
ARSARKRLARRKARLNHLKHLIANEFKLNYEDYQSFDESLAKAYKGSLIS
PYELRFRALNELLSKQDFARVILHIAKRRGYDDIKNSDDKEKGAILKAIK
QNEEKLANYQSVGEYLYKEYFQKFKENSKEFTNVRNKKESYERCIAQSFL
KDELKLIFKKQREFGFSFSKKFEEEVLSVAFYKRALKDFSHLVGNCSFFT
DEKRAPKNSPLAFMFVALTRIINNLNNLKNTEGILYTKDDLNALLNEVLK
NGTLTYKQTKKLLGLSDDYEFKGEKGTYFIEFKKYKEFIKALGEHNLSQD

-continued

DLNEIAKDITLIKDEIKLKKAKAYDLNQNQIDSLSKLEFKDHLNISFKA
LKLVTPLMLEGKKYDEACNELNLKVAINEDKKDFLPAFNETYYKDEVTNP
VVLRAIKEYRKVLNALLKKYGKVHKINIELAREVGKNHSQRAKIEKEQNE
NYKAKKDAELECEKLGLKINSKNILKLRLFKEQKEFCAYSGEKIKISDLQ
DEKMLEIDHIYPYSRSFDDSYMNKVLFTKQNQEKLNQTPFEAFGNDSAK
WQKIEVLAKNLPTKKQKRILDKNYKDKEQKNFKDRNLNDTRYIARLVLNY
TKDYLDFLPLSDDENTKLNDTQKGSKVHVEAKSGMLTSALRHTWGFSAKD
RNNHLHHAIDAVIIAYANNSIVKAFSDFKKEQESNSAELYAKKISELDYK
NKRKFFEPFSGFRQKVLDKIEIFVSKPERKKPSGALHEETFRKEEEFYQ
SYGGKEGVLKALELGKIRKVNGKIVKNGDMFRVDIFKHKKTNKFYAVPIY
TMDFALKVLPNKAVARSKKGEIKDWILMDENYEFCFSLYKDSLILIQTKD
MQEPEFVYYNAFTSSTVSLIVSKHDNKFETLSKNQKILFKNANEKEVIAK
SIGIQNLKVFEKYIVSALGEVTKAEFRQREDFKK

SEQ ID NO: 307
MKRILGLDLGTNSIGWALVNEAENKDERSSIVKLGVRVNPLTVDELTNFE
KGKSITTNADRTLKRGMRRNLQRYKLRRETLTEVLKEHKLITEDTILSEN
GNRTTFETYRLRAKAVTEEISLEEFARVLLMINKKRGYKSSRKAKGVEEG
TLIDGMDIARELYNNNLTPGELCLQLLDAGKKFLPDFYRSDLQNELDRIW
EKQKEYYPEILTDVLKEELRGKKRDAVWAICAKYFVWKENYTEWNKEKGK
TEQQEREHKLEGIYSKRKRDEAKRENLQWRVNGLKEKLSLEQLVIVFQEM
NTQINNSSGYLGAISDRSKELYFNKQTVGQYQMEMLDKNPNASLRNMVFY
RQDYLDEFNMLWEKQAVYHKELTEELKKEIRDIIIFYQRRLKSQKGLIGF
CEFESRQIEVDIDGKKKIKTVGNRVISRSSPLFQEFKIWQILNNIEVTVV
GKKRKRRKLKENYSALFEELNDAEQLELNGSRRLCQEEKELLAQELFIRD
KMTKSEVLKLLFDNPQELDLNFKTIDGNKTGYALFQAYSKMKIEMSGHEPV
DFKKPVEKVVEYIKAVFDLLNWNTDILGFNSNEELDNQPYYKLWHLLYSF
EGDNTPTGNGRLIQKMTELYGFEKEYATILANVSFQDDYGSLSAKAIHKI
LPHLKEGNRYDVACVYAGYRHSESSLTREEIANKVLKDRLMLLPKNSLHN
PVVEKILNQMVNVINVIDIYGKPDEIRVELARELKKNAKEREELTKSIA
QTTKAHEEYKTLLQTEFGLTNVSRTDILRYKLYKELESCGYKTLYSNTYI
SREKLFSKEFDIEHIIPQARLFDDSFSNKTLEARSVNIEKGNKTAYDFVK
EKFGESGADNSLEHYLNNIEDLFKSGKISKTKYNLKLKMAEQDIPDGFIER
DLRNTQYIAKKALSMLNEISHRVVATSGSVTDVLKLDREDWQLIDVMKELNWE
KYKALGLVEYFEDRDGRQIGRIKDWTKRNDHRHHAMDALTVAFTKDVFIQ
YFNNKNASLDPNANEHAIKNKYFQNGRAIAPMPLREFRAEAKKHLENTLI
SIKAKNKVITGNINKTRKKGGVNKNMQQTPRGQLHLETIYGSGKQYLTKE
EKVNASFDMRKIGTVSKSAYRDALLKRLYENDNDPKKAFAGKNSLDKQPI
WLDKEQMRKVPEKVKIVTLEAIYTIRKEISPDLKVDKVIDVGVRKILIDR
LNEYGNDAKKAFSNLDKNPIWLNKEKGISIKRVTISGISNAQSLHVKKDK
DGKPILDENGRNIPVDFVNTGNNHHVAVYYRPVIDKRGQLVVDEAGNPKY
ELEEVVVSFFEAVTRANLGLPIIDKDYKTTEGWQFLFSMKQNEYFVFPNE
KTGFNPKEIDLLDVENYGLISPNLFRVQKFSLKNYVFRHHLETTIKDTSS
ILRGITWIDFRSSKGLDTIVKVRVNHIGQVIVSVGEY

SEQ ID NO: 308
MSRKNYVDDYAISLDIGNASVGWSAFTPNYRLVRAKGHELIGVKLFDPAD
TAESRRMARTTRRRYSRRRWRLRLLDALFDQALSEIDPSFLARRKYSWVH
PDDENNADCWYGSVLFDSNEQDKRFYEKYPTIYHLRKALMEDDSQHDIRE
IYLAIHHMVKYRGNFLVEGTLESSNAFKEDELLKLLGRITRYEMSEGEQN
SDIEQDDENKLVAPANGQLADALCATRGSRSMRVDNALEALSAVNDLSRE
QRAIVKAIFAGLEGNKLDLAKIFVSKKEFSSENKKILGIYFNKSDYEEKCV
QIVDSGLLDDEEREFLDRMQGYNAIALKQLLGRSTSVSDSKCASYDAHR
ANWNLIKQLRTKENEKDINENYGILVGWKIDSGQRKSVRGESAYENMRK
KANVFFKKMIETSDLSETDKNRLIHDIEEDKLFPIQRDSDNGVIPHQLHQ
NELKQIIKKQGKYYPFLLDAFEKDGKQINKIEGLLTFRVPYFVGPLVVPE
DLQKSDNSENHWMVRKKKGEITPWNFDEMVDKDASGRKFIERLVGTDSYL
LGEPTLPKNSLLYQEYEVLNELNNVRLSVRTGNHWNDKRRMRLGREEKTL
LCQRLFMKGQTVTKRTAENLLRKEYGRTYELSGLSDESKFTSSLSTYGKM
CRIFGEKYVNEHRDLMEKIVELQTVFEDKETLLHQLRQLEGISEADCALL
VNTHYTGWGRLSRKLLTTKAGECKISDDFAPRKHSIIEIMRAEDRNLMEI
ITDKQLGFSDWIEQENLGAENGSSLMEVVDDLRVSPKVKRGIIQSIRLID
DISKAVGKRPSRIFLELADDIQPSGRTISRKSRLQDLYRNANLGKEFKGI
ADELNACSDKDLQDDRLFLYYTQLGKDMYTGEELDLDRLSSAYDIDHIY
QAVTQNDSIDNRVLVARAENARKTDSFTYMPQIADRMRNFWQILLDNGLI
SRVKFERLTRQNEFSEREKERFVQRSLVETRQIMKNVATLMRQRYGNSAA
VIGLNAELTKEMHRYLGFSHKNRDINDYHHAQDALCVGIAGQFAANRGFF
ADGEVSDGAQNSYNQYLRDYLRGYREKLSAEDRKQGRAFGFIVGSMRSQD
EQKRVNPRTGEVVWSEEDKDYLRKVMNYRKMLVTQKVGDDFGALYDETRY
AATDPKGIKGIPFDGAKQDTSLYGGFSSAKPAYAVLIESKGKTRLVNVTM
QEYSLLGDRPSDDELRKVLAKKKSEYAKANILLRHVPKMQLIRYGGGLMV
IKSAGELNNAQQLWLPYEEYCRDSQGKKGSLEKDDLKILKDSILGSVQ
CLYPWHRFTEEELADLHVAFDKLPEDEKKNVITGIVSALHADAKTANLSI
VGMTGSWRRMNNKSGYTFSDEDEFIFQSPSGLFEKRVTVGELKRKAKKEV
NSKYRTNEKRLPTLSGASQP

SEQ ID NO: 309
METQTSNQLITSHLKDYPKQDYFVGLDIGTNSVGWAVTNTSYELLKPHSH
KMWGSRLFEEGESAVTRRGFRSMRRRLERRKLRLKLLEELFADAMAQVDS
TFFIRLHESKYHYEDKTTGHSSKHILFIDEDYTDQDYFTEYPTIYHLRKD
LMENGTDDIRKLFLAVHHILKYRGNFLYEGATFNSNAFTFEDVLKQALVN

ITFNCFDTNSAISSISNILMESGKTKSDKAKAIERLVDTYTVFDEVNTPD
KPQKEQVKEDKKTLKAFANLVLGLSANLIDLFGSVEDIDDDLKKLQIVGD
TYDEKRDELAKVWGDEIHIIDDCKSVYDAIILMSIKEPGLTISQSKVKAF
DKHKEDLVILKSLLKLDRNVYNEMFKSDKKGLHNYVHYIKQGRTEETSCS
REDFYKYTKKIVEGLADSKDKEYILNEIELQTLLPLQRIKDNGVIPYQLH
LEELKVILDKCGPKFPFLHTVSDGFSVTEKLIKMLEFRIPYYVGPLNTHH
NIDNGGFSWAVRKQAGRVTPWNFEEKIDREKSAAAFIKNLTNKCTYLFGE
DVLPKSSLLYSEFMLLNELNNVRIDGKALAQGVKQHLIDSIFKQDHKKMT
KNRIELFLKDNNYITKKHKPEITGLDGEIKNDLTSYRDMVRILGNNFDVS
MAEDIITDITIFGESKKMLRQTLRNKFGSQLNDETIKKLSKLRYRDWGRL
SKKLLKGIDGCDKAGNGAPKTIIELMRNDSYNLMEILGDKFSFMECIEEE
NAKLAQGQVVNPHDIIDELALSPAVKRAVWQALRIVDEVAHIKKALPSRI
FVEVARTNSKEKKKDSRQKRLSDLYSAIKKDDVLQSGLQDKEFGALKSG
LANYDDAALRSKKLYLYYTQMGRCAYTGNIIDLNQLNTDNYDIDHIYPRS
LTKDDSFDNLVLCERTANAKKSDIYPIDNRIQTKQKPFWAFLKHQGLISE
RKYERLTRIAPLTADDLSGFIARQLVETNQSVKATTTLLRRLYPDIDVFF
VKAENVSDFRHNNNFIKVRSLNHHHHAKDAYLNIVVGNVYHEKFTRNFRL
FFKKNGARNTYNLAKMFNYDVICTNAQDGKAWDVKTSMNTVKKMMASNDV
RVTRRLLEQSGALADATIYKASVAAKAKDGAYIGMKTKYSVFADVTKYGG
MTKIKNAYSIIVQYTGKKGEEIKEIVPLPIYLINRNATDIELIDYVKSVI
PKAKDISIKYRLCINQLVKVNGFYYLGGKTNDKIYIDNAIELVVPHDI
ATYIKLLDKYDLLRKENKTLKASSITSIYNINTSVVSLNKVGIDVFDV
FMSKLRTPLYMKMKGNKVDELSSTGRSKFIKMTLEEQSIYLLEVLNLLTN
SKTTFDVKPLGITGSRSTIGVKIHNLDEFKIINESITGLYSNEVTIV

SEQ ID NO: 310
MTKLNQPYGIGLDIGSNSIGFAVVDANSHLLRLKGETAIGARLFREGQSA
ADRRGSRTTRRRLSRTRWRLSFLRDFFAPHITKIDPDFFLRQKYSEISPK
DKDRFKYEKRLFNDRTDAEFYEDYPSMYHLRLHLMTHTHKADPREIFLAI
HHILKSRGHFLTPGAAKDFNTDKVDLEDIFPALTEAYAQVYPDLELTFDL
AKADDFKAKLLDEQATPSDTQKALVNLLLSSDGEKEIVKKRKQVLTEFAK
AITGLKTKFNLALGTEVDEADASNWQFSMGQLDDKWSNIETSMTDQGTEI
FEQIQELYRARLLNGIVPAGMSLSQAKVADYGQHKEDLELFKTYLKKLND
HELAKTIRGLYDRYINGDDAKPFLREDFVKALTKEVTAHPNEVSEQLLNR
MGQANFMLKQRTKANGAIPIQLQQRELDQIIANQSKYYDWLAAPNPVEAH
RWKMPYQLDELLNFHIPYYVGPLITPKQQAESGENVFAWMVRKDPSGNIT
PYNFDEKVDREASANTFIQRMKTTDTYLIGEDVLPKQSLLYQKYEVLNEL
NNVRINNECLGTDQKQRLIREVFERHSSVTIKQVADNLVAHGDFARRPEI
RGLADEKRFLSSLSTYHQLKEILHEAIDDPTKLLDIENIITWSTVFEDHT
IFETKLAEIEWLDPKKINELSGIRYRGWGQFSRKLLDGLKLGNGHTVIQE
LMLSNHNLMQILADETLKETMTELNQDKLKTDDIEDVINDAYTSPSNKKA
LRQVLRVVEDIKHAANGQDPSWLFIETADGTGTAGKRTQSRQKQIQTVYA
NAAQELIDSAVRGELEDKIADKASFTDRLVLYFMQGGRDIYTGAPLNIDQ
LSHYDIDHILPQSLIKDDSLDNRVLVNATINREKNNVFASTLFAGKMKAT
WRKWHEAGLISGRKLRNLMLRPDEIDKFAKGFVARQLVETRQIIKLTEQI
AAAQYPNTKIIAVKAGLSHQLREELDFPKNRDVNHYHHAFDAFLAARIGT
YLLKRYPKLAPFFTYGEFAKVDVKKFKREFNFIGALTHAKKNIIAKDTGEI
VWDKERDIRELDRIYNFKRMLITHEVYFETADLFKQTIYAAKDSKERGGS
KQLIPKKQGYPTQVYGGYTQESGSYNALVRVAEADTTAYQVIKISAQNAS
KIASANLKSREKGKQLLNEIVVKQLAKRRKNWKPSANSFKIVIPRFGMGT
LFQNAKYGLFMVYNQELWLSRENQKLLKKLFSIKYEKTYQNMNHD
ALQVYKAIIDQVEKFFKLYDINQFRAKLSDAIERFEKLPINTDGNKIGKT
ETLRQILIGLQANGTRSNVKNLGIKTDLGLLQVGSGIKLDKDTQIVYQSP
SGLFKRRIPLADL

SEQ ID NO: 311
MTKEYYLGLDVGTNSVGWAVTDSQYNLCKFKKKDMWGIRLFESANTAKDR
RLQRGNRRRLERKKQRIDLLQEIFSPEICKIDPTFFIRLNESRLHLEDKS
NDFKYPLFIEKDYSDIEYYKEFPTIFHLRKHLIESEEKQDIRLIYLALHN
IIKTRGHFLIDGDLQSAKQLRPILDTFLLSLQEEQNLSVSLSENQKDEYE
EILKNRSIAKSEKVKKLKNLFEISDELEKEEKKAQSAVIENFCKFIVGNK
GDVCKFLRVSKEELEIDSFSFSEGKYEDDIVKNLEEKVPEKVYLFEQMKA
MYDWNILVDILETEEYISFAKVKQYEKHKTNLRLLRDIILKYCTKDEYNR
MFNDEKEAGSYTAYVGKLKKNNKKYWIEKKRNPEEFYKSLGKLLDKIEPL
KEDLEVLTMMIEECKNHTLLPIQKNKDNGVIPHQVHEVELKILENAKKY
YSFLTETDKDGYSVVQKIESIFRFRIPYVGPLSTRHQEKGSNVWMVRKP
GREDRIYPWNMEEIIDFEKSNENFITRMTNKCTYLIGEDVLPKHSLLYSK
YMVLNELNNVKVRGKKLPTKVKQKVFEDLFENKSKVTGKNLLEYLQQDK
DIQIDDLSGFDKDFKTSLKSYLDFKKQIFGEEIEKESIQNMIEDIIKWIT
IYGNDKEMLKRVIRANYSNQLTEEQMKKITGFQYSGWGNFSKMPLKGISG
SDVSTGETFDIITAMWETDNNLMQILSKKFTFMDNVEDFNSGKVGKIDKI
TYDSVKEMFLSPENKRAVWQTIQVAEEIKKVMGCEPKKIFIEMARGEKK
VKKRTKSRKAQLLELYAACEEDCRELIKEIEDRDERDFNSMKLFLYYTQF
GKCMYSGDDIDINELIRGNSKWDRDHIYPQSKIKDDSIDNLVLVNKTYNA
KKSNELLSEDIQKKMHSFWLSLLNKKLITKSKYDRLTRKGDFTDEELSGF
IARQLVETRQSTKAIADIFQIYSSEVVYLKSRFRKKPLNYLKSR
VNDYHHAKDAYLNIVVGNVYNKKFTSNPIQWMKKNRDTNYSLNKVFEHDV
VINGEVIWEKCTYHEDTNTYDGGTLDRIRKIVERDNILYETEYAYCEKGEL
FNATIQNKNGNSTVSLKKGLDVKKYGGYFSANTSYFSLIEFEDKKGDRAR
HIIGVPIYIANMLEHSPSAFLEYCEQKGYQNVRILVEKIKKNSLLIINGY
PLRIRGENEVDTSFKRAIQLKLDQKNYELVRNIEKFLEKYVEKKGNYPID

-continued

ENRDHITHEKMNQLYEVLLSKMKKFNKKGMADPSDRIEKSKPKFIKLEDL
IDKINVINKMLNLLRCDNDTKADLSLIELPKNAGSFVVKKNTIGKSKIIL
VNQSVTGLYENRREL

SEQ ID NO: 312

MARDYSVGLDIGTSSVGWAAIDNKYHLIRAKSKNLIGVRLFDSAVTAEKR
RGYRTTRRRLSRRHWRLRLLNDIFAGPLTDFGDENFLARLKYSWVHPQDQ
SNQAHFAAGLLFDSKEQDKDFYRKPTIYHLRLALMNDDQKHDLREVYLA
IHHLVKYRGHFLIEGDVKADSAFDVHTFADAIQRYAESNNSDENLLGKID
EKKLSAALTDKHGSKSQRAETAFDILDLQSKKQIQAILKSVVGNQAN
LMAIFGLDSSAISKDEQKNYKFSFDDADIDEKIADSEALLSDTEFEFLCD
LKAAFDGLTLKMLLGDDKTVSAAMVRRFNEHQKDWEYIKSHIRNAKNAGN
GLYEKSKKFDGINAAYLALQSDNEDDRKKAKKIFQDEISSADIPDDVKAD
FLKKIDDDQFLPIQRTKNNGTIPHQLHRNELEQIIEKQGIYYPFLKDTYQ
ENSHELNKITALINFRVPYYVGPLVEEEQKIADDGKNIPDPTNHWMVRKS
NDTITPWNLSQVVDLDKSGRRFIERLTGTDTYLIGEPTLPKNSLLYQKFD
VLQELNNIRVSGRRLDIRAKQDAFEHLFKVQKTVSATNLKDFLVQAGYIS
EDTQIEGLADVNGKNFNNALTTYNYLVSVLGREFVENPSNEELLEEITEL
QTVFEDKKVLRRQLDQLDGLSDHNREKLSRKHYTGWGRISKKLLTTKIVQ
NADKIDNQTFDVPRMNQSIIDDTLYNTKMNLMEIINNAEDDFGVRAWIDKQ
NTTDGDEQDVYSLIDELAGPKEIKRGIVQSFRILDDITKAVGYAPKRVYL
EFARKTQESHLTNSRKNQLSTLLKNAGLSELVTQVSQYDAAALQNDRLYL
YFLQQGKDMYSGEKLNLDNLSNYDIDHIIPQAYTKDNSLDNRVLVSNITN
RRKSDSSNYLPALIDKMRPFWSVLSKQGLLSKHKFANLTRTRDFDDMEKE
RFIARSLVETRQIIKNVASLIDSHFGGETKAVAIRSSLTADMRRYVDIPK
NRDINDYHHAFDALLFSTVGQYTENSGLMKKGQLSDSAGNQYNRYIKEWI
HAARLNAQSQRVNPFGFVVGSMRNAAPGKLNPETGEITPEENADWSIADL
DYLHKVMNFRKITVTRRLKDQKGQLYDESRYPSVLHDAKSKASINFDKHK
PVDLYGGFSSAKPAYAALIKFKNKFRLVNVLRQWTYSDKNSEDYILEQIR
GKYPKAEMVLSHIPYGQLVKDLQALVTISSATELHNFEQLWLPLADYKLI
NTLLKKTKEDNLVDILHNRLDLPEMTIESAFYKAFDSILSFAFNRYALHQN
ALVKLQAHRDDFNALNYEDKQQTLERIILDALHASPASSDLKKINLSSGFG
RLFSPSHFTLADTDEFIFQSVTGLFSTQKTVAQLYQETK

SEQ ID NO: 313

MVYDVGLDIGTGSVGWVALDENGKLARAKGKNLVGVRLFDTAQTAADRRG
FRTTTRRRLSRRKWRLRLLDELFSAEINEIDSSFFQRLKYSYVHPKDEENK
AHYYGGYLFPTEEETKKFHRSYPTIYHLRQELMAQPNKRFDIREIYLAIH
HLVKYRGHFLSSQEKITIGSTYNPEDLANAIEVYADEKGLSWELNNPEQL
TEIISGEAGYGLNKSMKADEALKLFEFDNNQDKVAIKTLLAGLTGNQIDF
AKLFGKDISDKDEAKLWKLKLDDEALEEKSQTILSQLTDEEIELFHAVVQ
AYDGFVLIGLLNGADSVSAAMVQLYDQHREDRKLLKSLAQKAGLKHKRFS
EIYEQLALATDEATIKNGISTARELVEESNLSKEVKEDTLRRLDEMQTKF
KQRTKANSVIPHQLHLAELQKILQNQGQYYPFLLDTFEKEDGQDNKIEEL
LRFRIPYYVGPLVTKKDVEHAGGDADNHWVERNEGFEKSRVTPWNFDKVF
NRDKAARDFIERLTGNDTYLIGEKTLPQNSLRYQLFTVLNELNNVRVNGK
KFDSKTKADLINDLHFKARKTVSLSALKDLPKAQGKGDVTITGLADESKFN
SSLSSYNDLKKTFDAEYLENEDNQETLEKIIEIQTVFEDSKIASRELSKL
PLDDDDQVKKLSQTHYTGWGRLSEKLLDSKIIDERGQKVSILDKLKSTSQN
FMSIINNDKYGVQAWITEQNTGSSKLTFDEKVNELTTSPANKRGIKQSFA
VLNDIKKAMKEEPRRVYLEFAREDQTSVRSVPRYNQLKEKYQSKSLSEEA
KVLKKTLDGNKNKMSSDDRYFLYFQQQGKDMYTGRPINFERLSQDYDIDHI
IPQAFTKDDSLDNRVLVSRPENARKSDSFAYTDEVQKQDGSLWTSLLKSG
FINRKKYERLTKAGKYLDGQKTGFIARQLVETRQIIKNVASLIEGEYENS
KAVAIRSEITADMRLLVLKHREINSFHHAFDALLITAAGQYMQNRYPD
RDSTNVYNEFDRYTNDYLKNLRQLSSRDEVRRLKSFGFVVGTMRKGNEDW
SEENTSYLRKVMMFKNILTTKKTEKDRGPLNKETIFSPKSGKKLIPLNSK
RSDTALYGGYSNVYSAYMTLVRANGKNLLIKIPISIANQIEVGNLKINDY
IVNNPAIKKFEKILISKLPLGQLVKDRNLIYLASNEYRHNAKQLWLSTT
DADKIASISENSSDEELLEAYDILTSENVKNRFPFFKKDIDKLSQVRDEF
LDSDKRIAVIQTILRGLQIDAAYQAPVKIISKKVSDWHKLQQSGGIKLSD
NSEMIYQSATGIFETRVKISDLL

SEQ ID NO: 314

IVDYCIGLDLGTGSVGWAVVDMNHRLMKRNGKHLWGSRLFSNAETAANRR
ASRSIRRRYNKRRERIRLLRAILQDMVLEKDPTFFIRLEHTSFLDEEDKA
KYLGTDYKDNYNLFIDEDFNDYTYYHKYPTIYHLRKALCESTEKADPRLI
YLALHHIVKYRGNFLYEGQKFNMDASNIEDKLSDIFTQFTSFNNIPYEDD
EKKNLEILEILKKPLSKKAKVDEVMTLIAPEKDYKSAFKELVTGIAGNKM
NVTKMILCEPIKQGDSEIKLKFSDSNYDDQFSEVEKDLGEYVEFVDALHN
VYSWVELQTIMGATHTDNASISEAMVSRYNKHHDDLKLLKDCIKNNVPNK
YFDMFRNDSEKSKGYYNYINRPSKAPVDEFYKYVKKCIEKVDTPEAKQIL
NDIELENFLLKQNSRTNGSVPYQMQLDEMIKIIDNQAEYYPILKEKREQL
LSILTFRIPYYGPLNETSEHAWIKRLEGKENQRILPWNYDIVDVDATA
EGFIKRMRSYCTYFPDEEVLPKNSLIVSKYEVYNELNKIRVDDKLLEVDV
KNDIVNELFMKNKTVTEKKLKNNLVNNQCCSKDAEIKGFQKENQFSTSLT
PWIDFTNIFGKIDQSNFDLIENIIIYDLTVFEDKKIMKRRLKKKYALPDDK
VKQILKLKYKDWSRLSKKLLDGIVADNRFGSSVTVLDVLEMSRLNLMEII
NDKDLGYAQMIEEATSCPEDGKFTYEEVERLAGSPALKRGIWQSLQIVEE
ITKVMKCRPKYIYIEFERSEEAKERTESKIKKLENVYKDLDEQTKKEYKS
VLEELKGFDNTKKISSDSLFLYFTQLGKCMYSGKKLDIDSLDKYQIDHIV

-continued

PQSLVKDDSFDNRVLVVPSENQRKLDDLVVPFDIRDKMYRFWKLLFDHEL
ISPKKFYSLIKTEYTERDEERFINRQLVETRQITKNVTQIIEDHYSTTKV
AAIRANLSHEFRVKNHIYKNRDINDYHHAHDAYIVALIGGFMRDRYPNMH
DSKAVYSEYMKMFRKNKNDQKRWKDGFVINSMNYPYEVDGKLIWNPDLIN
EIKKCFYYKDCYCTTKLDQKSGQLFNLTVLSNDAHADKGVTKAVVPVKN
RSDVHKYGGFSGLQYTIVAIEGQKKKGKKTELVKKISGVPLHLKAASINE
KINYIEEKEGLSDVRIIKDNIPVNQMIEMDGGEYLLTSPTEYVNARQLVL
NEKQCALIADIYNAIYKQDYDNLDDILMIQLYIELTNKMKVLYPAYRGIA
EKFESMNENYVVISKEEKANIIKQMLIVMHRGPQNGNIVYDDFKISDRIG
RLKTKNHNLNNIVFISQSPTGIYTKKYKL

SEQ ID NO: 315

MKSEKKYYIGLDVGTNSVGWAVTDEFYNILRAKGKVGVRLFEKADTAA
NTRIFRSGRRRNDRKGMRLQILREIFEDEIKKVDKDFYDRLDESKFWAED
KKVSGKYSLFNDKNFSDKQYFEKFPTIFHLRKYLMEEHGKVDIRYYFLAI
NQMMKRRGHFLIDGQISHVTDDKPLKEQLILLINDLLKIELEEELMDSIF
EILADVNEKRTDKKNNLKELIKGQDFNKQEGNILNSIFESIVTGKAKIKN
IISDEDILEKIKEDNKEDFVLTGDSYEENLQYFEEVLQENITLFNTLKST
YDFLILQSILKGKSTLSDAQVERYDEHKKDLEILKKVIKKYDEDGKLFKQ
VFKEDNGNGYVSYIGYYLNKNKKITAKKKISNIEFTKYVKGILEKQCDCE
DEDVKYLLGKIEQENFLLKQISSINSVIPHQIHLFELDKILENLAKNYPS
FNNKKEEFTKIEKIRKTFTFTRIPYYVGPLNDYHKNNGGNAWIFRNKGEKI
RPWNFEKIVDLHKSEEEFIKRMLNQCTYLPEETVLPKSSILYSEYMVLNE
LNNLRINGKPLDTDVKLKLIEELFKKKTKVTLKSIRDYMVRNNFADKEDF
DNSEKNLEIASNMKSYIDFNNILEDKFDVEMVEDLIEKITIHTGNKKLLK
KYIEEYICPNGKVFSKLRLSRKLLDGIKGTKKETEKTDTV
INFLRNSSDNLMQIIGSQNYSFNEYIDKLRKKYIPQEISYEVVENLYVSP
SVKKMIWQVIRVTEEITKVMGYDPDKIFIEMAKSEEEKKTTISRKNKLLD
LYKAIKKDERDSQYEKLLTGLNKLDDSDLRSRKLYLYYTQMGRDMYTGEK
IDDLKLFDSTHYDKDHIIPQSMKKDDSIINNLVLVNKNANQTTKGNIYPV
PSSIRNNPKIYNYWKYLMEKEFISKEKYNRLIRNTPLTNEELGGFINRQL
VETRQSTKAIKELFEFKYQKSKIIPVKASLASDLRKDMNTLKSREVNDLH
HAHDAFLNIVAGDVWNREFTSNPINYVKENREGDKVKYSLSKDFTRPRKS
KGKVIWTPEKGRKLIVDTLNKPSVLISNESHVKKGELFNATIAGKKDYKK
GKIYLPLKKDDRLQDVSKYGGYKAINGAFFFLVEHTKSKKRIRSIELFPL
HLLSKFYEDKNTVLDYAINVLQLQDPKIIIDKINYRTEIIIDNFSYLIST
KSNDGSITVKPNEQMYWRVDEISNLKKIENKYKKDAILTEEDRKIMESYI
DKIYQQFKAGKYKNRRTTDTIIEKYEIIDLDTLDNKQLYQLLVAFISLSY
KTSNNAVDFTVIGLGTECGKPRITNLPDNTYLVYKSITGIYEKRIRIK

SEQ ID NO: 316

MKLRGIEDDYSIGLDMGTSSVGWAVTDERGTLAHFKRKPTWGSRLFREAQ
TAAVARMPRGQRRRYVRRRWRLDLLQKLFEQQMEQADPDFFIRLRQSRLL
RDDRAEEHADYRWPLFNDCKFTERDYYQRFPTIYHVRSWLMETDEQADIR
LIYLALHNIVKHRGNFLREGQSLSAKSARPDEALNHRETLRVWSSERGF
ECSIADNGSILAMLTHPDLSPSDRRKKIAPLFDVKSDDAAADKKLGIALA
GAVIGLKTEFKNIFGDFPCEDSSIYLSNDEAVDAVRSACPDDCAELFDRL
CEVYSAYVLQGLLSYAPGQTISANMVEKYRRYGEDLALLKKLVKIYAPDQ
YRMFFSGATYPGTGIYDAAQARGYTKYNLGPKKSEYKPSESMQYDDFRKA
VEKLFAKTDARADERYMMMDRFDKQQFLRRLKTSDNGSIYHQLHLEELK
AIVENGQRFYPFLKRADLKEEYGSRLSAEQIKTICKKRFTGW
GRLSEKFLTGITVQVDEDSVSIMDVLREGCPVSGKRGRAMVMMEILRDEE
LGFQKKVDDFNRAFFAENAQALGVNELPGSPAVRRSLNQSIRIVDEIASI
AGKAPANIFIEVTRDEDPKKKGRRTKRRYNDLKDALEAFKKEDPELWREL
CETAPNDMDERLSLYFMQRGKCLYSGRAIDIHQLSNAGIYEVDHIIPRTY
VKDDSLENKALVYREENQRKTDMLLIDPEIRRRMSGYWRMLHEAKLIGDK
KFRNLLRSRIDDKALKGFIARQLVETGQMVKLVRSLLEARYPETNIISVK
ASISHDLRTAAELVKCREANDFHHAHDAFLACRVGLFIQKRHPCVYENPI
GLSQVVRNYVRQQADIFKRCRTIPGSSGFIVNSFMTSGFDKETGEIFKDD
WDAEAEVEGIRRSLNFRQCFISRMPFEDHGVFWDATIYSPRAKKTAALPL
KQGLNPSRYGSFSREQFAYFFIYKARNPRKEQTLFEFAQVPVRLSAQIRQ
DENALERYARELAKDQGLEFIRIERSKILKNQLIEIDGDRLCITGKEEVR
NACELAFAQDEMRVIRMLVSEKPVSRECVISLFNRILLHGDQASRRLSKQ
LKLALLSEAFSEASDNVQRNVVLGLIAIFNGSTNMVNLSDIGGSKFAGNV
RIKYKKELASPKVNVHLIDQSVTGMFERRTKIGL

SEQ ID NO: 317

MENKQYYIGLDVGTNSVGWAVTDTSYNLLRAKGKDMWGARLFEKANTAAE
RRTKRTSRRRSEREKARKAMLKELFADEINRVDPSFFIRLEESKFFLDDR
SENNRQRYTLFNDATFTDKDYYEKYKTIFHLRSALINDSEKFDVRLVFLA
ILNLFSHRGHFLNASLKGDGDIQGMDVFYNDLVESCEYFEIELPRITNID
NFEKILSQKGKSRTKILEELSEELSISKKDKSKYNLIKLISGLEASVVEL
YNIEDIQDENKKIKIGFRESDYEESSLKVKEIIGDEYFDLVERAKSVHDM
GLLSNIIGNSKYLCEARVEAYENHHKDLLKELKKLYKDKKAYNDMFRKM
TDKNYSAYVGSVNSNIAKERRSVDKRKIEDLYKYIEDTALKNIPDDNKDK
IEILEKIKLGEFLKKQLTASNGVIPNQLQSRELRAILKKAENYLPFLKEK
GEKNLTVSEMIIQLFEFQIPYYVGPLDKNPKKDNKANSWAKIKQGGRILP

```
-continued
WNFEDKVDVKGSRKEFIEKMVRKCTYISDEHTLPKQSLLYEKFMVLNEIN
NIKIDGEKISVEAKQKIYNDLFVKGKKVSQKDIKKELISLNIMDKDSVLS
GTDTVCNAYLSSIGKFTGVFKEEINKQSIVDMIEDIIFLKTVYGDEKRFV
KEEIVEKYGDEIDKDKIKRILGFKFSNWGNLSKSFLELEGADVGTEVRS
IIQSLWETNFNLMELLSSRFTYMDELEKRVKKLEKPLSEWTIEDLDDMYL
SSPVKRMIWQSMKIVDEIQTVIGYAPKRIFVEMTRSEGEKVRTKSRKDRL
KELYNGIKEDSKQWVKELDSKDESYFRSKKMYLYYLQKGRCMYSGEVIEL
DKLMDDNLYDIDHIYPRSFVKDDSLDNLVLVKKEINNRKQNDPITPQIQA
SCQGFWKILHDQGFMSNEKYSRLTRKTQEFSDEEKLSFINRQIVETGQAT
KCMAQILQKSMGEDVDVVFSKARLVSEFRHKFELFKSRLINDFHHANDAY
LNIVVGNSYFVKFTRNPANFIKDARKNPDNPVYKYHMDRFFERDVKSKSE
VAWIGQSEGNSGTIVIVKKTMAKNSPLITKKVEEGHGSITKETIVGVKEI
KFGRNKVEKADKTPKKPNLQAYRPIKTSDERLCNILRYGGRTSISISGYC
LVEYVKKRKTIRSLEAIPVYLGRKDSLSEEKLLNYFRYNLNDGGKDSVSD
IRLCLPFISTNSLVKIDGYLYYLGGKNDDRIQLYNAYQLKMKKEEVEYIR
KIEKAVSMSKFDEIDREKNPVLTEEKNIELYNKIQDKFENTVFSKRMSLV
KYNKKDLSFGDFLKNKKSKFEEIDLEKQCKVLYNIIFNLSNLKEVDLSDI
GGSKSTGKCRCKKNITNYKEFKLIQQSITGLYSCEKDLMTI SEQ ID NO: 318
MKNLKEYYIGLDIGTASVGWAVTDESYNIPKFNGKKMWGVRLFDDAKTAE
ERRTQRGSRRRLNRRKERINLLQDLFATEISKVDPNFFLRLDNSDLYRED
KDEKLKSKYTLFNDKDFKDRDYHKKYPTIHHLIMDLIEDEGKKDIRLLYL
ACHYLLKNRGHFIFEGQKFDTKNSFDKSINDLKIHLRDEYNIDLEFNNED
LIEEIITDTTLNKTNKKKELKNIVGDTKFLKAISAIMIGSSQKLVDLFEDG
EFEETTVKSVDFSTTAFDDKYSEYEEALGDTISLLNILKYLDYSSILENL
LKDADKSKDGNKYISKAFVKKFNKHGKDLKTLKRIIKKYLPSEYANIFRN
KSINDNYVAYTKSNITSNKRTKASKFTKQEDFYKFIKKHLDTIKETKLNS
SENEDLKLIDEMLTDIEFKTFIPKLKSSDNGVIPYQLKLMELKKILDNQS
KYYDFLNESDEYGTVKDKVESIMEFRIPYYVGPLNPDSKYAWIKRENTKI
TPWNFKDIVDLDSSREEFIDRLIGRCTYLKEEKVLPKASLIYNEFMVLNE
LNNLKLNEFLITEEMKKAIFEELFKTKKKVTLKAVSNLLKKEFNLTGDIL
LSGTDGDFKQGLNSYIDFKNIIGDKVDRDDYRIKIEEIIKLIVLYEDDKT
YLKKKIKSAYKNDFTDDEIKKIAALNYKDWGRLSKRFLTGIEGVDKTTGE
KGSIIYFMREYNLNLMELMSGHYTFTEEVEKLNPVENRELCYEMVDELYL
SPSVKRMLWQSLRVVDEIKRIIGKDPKKIFIEMARAKEAKNSRKESRKNK
LLEFYKFGKKAFINEIGEERYNYLLNEINSEEESKFRWDNLYLYYTQLGR
CMYSLEPIDLADLKSNNIYDQDHIYPKSKIYDDSLENRVLVKKNLHEKG
NQYPIPEKVLNKNAYGFWKILFDKGLIGQKKYTRLTRRTPFEERELAEFI
ERQIVETRQATKETANLLKNICQDSEIVYSKAENASRFRQEFDIIKCRTV
NDLHHMHDAYLNIVVGNVYNTKFTKNPLNFIKDKDNVRSYNLENMPKYD
VRGSYTAWIADDSEGNVKAATIKKVKRELEGKNYRFTRMSYIGTGGLYDQ
NLMRKGKGQIPQKENTNKSNIEKYGGYNKASSAYFALIESDGKAGRERTL
ETIPIMVYNQEKYGNTEAVDKYLKDNLELQDPKILKDKIKINSLIKLDGF
LYNIKGKTGDSLSIAGSVQLIVNKEEQKLIKKMDKFLVKKKDNKDIKVTS
FDNIKEEELIKLYKTLSDKLNNGIYSNKRNNQAKNISEALDKFKEISIEE
KIDVLNQIILLFQSYNNGCNLKSIGLSAKTGVVFIPKKLNYKECKLINQS
ITGLFENEVDLLNL SEQ ID NO: 319
MGKMYYLGLDIGTNSVGYAVTDPSYHLLKFKGEPMWGAHVFAAGNQSAER
RSFRTSRRRLDRRQQRVKLVQEIFAPVISPIDPRFFIRLHESALWRDDVA
ETDKHIFFNDPTYTDKEYYSDYPTIHHLIVDLMESSEKHDPRLVYLAVAW
LVAHRGHFLNEVDKDNIGDVLSFDAFYPEFLAFLSDNGVSPWVCESKALQ
ATLLSRNSVNDKYKALKSLIFGSQKPEDNFDANISEDGLIQLLAGKKVKV
NKLFPQESNDASFTLNDKEDAIEEILGTLTPDECEWIAHIRRLFDWAIMK
HALKDGRTISESKVKLYEQHHHDLTQLKYFVKTYLAKEYDDIFRNVDSKT
TKNYVAYSYHVKEVKGTLPKNKATQEEFCKYVLGKVKNIECSEADKVDFD
EMIQRLTDNSFMPKQVSGENRVIPYQLYYYELKTILNKAASYLPFLTQCG
KDAISNQDKLLSIMTFRIPYFVGPLRKDNSEHAWLERKAGKIYPWNFNDK
VDLDKSEEAFIRRMTNTCTYYPGEDVLPLDSLIYEKFMILNEINNIRIDG
YPISVDVKQQVFGLFEKKRRVTVKDIQNLLLSLGALDKKYAGNSLIDTTIH
SNYNTYHHFKSLMERGVLTRDDVERIVERMTYSDDTKRVRLWLNNNYGTL
TADDVKHISRLRKHDFGRLSKMFLTGLGKGVHKETGERASILDPMWNTNDN
LMQLLSECYTFSDEITKLQEAYYAKAQLSLNDFLDSMYISNAVKRPIYRT
LAVVNDIRKACGTAPKRIFIEMARDGESKKKRSVTRREQIKNLYRSIRKD
FQQEVDFLEKILENKSDGQLQSDALYLYFAQLGRDMYTGDPIKLEHIKDQ
SFYNIDHIYPQSMVKDDSLDNKVLVQSEINGEKSSRYPLDAAIRNKMKPL
WDAYYNHGLISLKKYQRLTRSTPFTDDEKWDFINRQLVETRQSTKALAIL
LKRKFPDTEIVYSKAGLSSDFRHEFGLVKSRNINDLHHAKDAFLAIVTGN
VYHERFNRRWFMVNQPYSVKTKTLFTHSIKNGNFVAWNGEEDLGRIVKML
KQNKNTIHFTRFSFDRKEGLFDIQPLKASTGLVPRKAGLDVVKYGGYDKS
TAAYYLLVRFTLEDKKTQHKLMMIPVEGLYKARIDHDKEFLTDYAQTTIS
EILQKDKQKVINIMFPMGTRHIKLNSMISIDGFYLSIGGKSSKGKSVLCH
AMVPLIVPHKIECYIKAMESFARKFKENNLKRIVEVEKFDKITVEDNLNYE
LFLQKLQHNPYNKFFSTQFDVLTNGRSTFTKLSPEEQVQTLLNILSIFKT
CRSSGCDLKSINGSAQAARIMISADLTGLSKKYSDIRLVEQSASGLFVSK
SQNLLEYL SEQ ID NO: 320
MTKKEQPYNIGLDIGTSSVGWAVTNDNYDLLNIKKKNLWGVRLFEEAQTA
KETRLNRSTRRRYRRRKNRINWLNEIFSEELAKTDPSFLIRLQNSWVSKK
DPDRKRDKYNLFIDGPYTDKEYYREFPTIPHLRKELILNKDKADIRLYL
ALHNILKYRGNFTYEHQKFNISNLNNNLSKELIELNQQLIKYDISFPDDC
DWNHISDILIGRGNATQKSSNILKDFTLDKETKKLLKEVINLILGNVAHL
NTIFKTSLTKDEEKLNFSGKDIESKLDDLDSILDDDQFTVLDAANRIYST
ITLNEILNGESYFSMAKVNQYENHAIDLCKLRDMWHTTKNEEAVEQSRQA
YDDYINKPKYGTKELYTSLKKFLKVALPTNLAKEAEEKISKGTYLVKPRN
SENGVVPYQLNKIEMEKIIDNQSQYYPFLKENKEKLLSILSFRIPYYVGP
LQSAEKNPFAWMERKSNGHARPWNFDEIVDREKSSNKFIRRMTVTDSYLV
GEPVLPKNSLIYQRYEVLNELNNIRITENLKTNPIGSRLTVETKQRIYNE
LFKKYKKVTVKKLTKWLIAQGYYKNPILIGLSQKDEFNSTLTTYLDMKKI
FGSSFMEDNKNYDQIEELIEWLTIFEDKQILNEKLHSSKYSYTPDQIKKI
SNMRYKGWGRLSKKILMDITTETNTPQLLQLSNYSILDLMWATNNNFISI
MSNDKYDFKNYIENHNLNKNEDQNISDLVNDIHVSPALKRGITQSIKIVQ
EIVKFMGHAPKHIFIEVTRETKKSEITTSREKRIKRLQSKLLNKANDFKP
QLREYLVPNKKIQEELKKHKNDLSSERIMLYFLQNGKSLYSEESLNINKL
SDYQVDHILPRTYIPDDSLENKALVLAKENQRKADDLLLNSNVIDRNLER
WTYMLNNNMIGLKKFKNLTRRVITDKDKLGFIHRQLVQTSQMVKGVANIL
DNMYKNQGTTCIQARANLSTAFRKALSGQDDTYHFKHPELVKNRNVNDFH
HAQDAYLASFLGTYRLRRFPTNEMLLMNGEYNKFYGQVKELYSKKKKLPD
SRKNGFIISPLVNGTTQYDRNTGEIIWNVGFRDKILKIFNYHQCNVTRKT
EIKTGQFYDQTIYSPKNPKYKKLIAQKKDMDPNIYGGFSGDNKSSITIVK
IDNNKIKVPAIPIRLINDLKDHKTLQNWLEENVKHKKSIQIIKNNVPIGQ
IIYSKKVGLLSLSNDREVANRQQLILPPEHSALLRLLQIPDEDLDQILAF
YDKNILVEILQELITKMKKFYPFYKGEREFLIANIENFNQATTSEKVNSL
EELITLLHANSTSAHLIFNNIEKKAFGRKTHGLTLNNTDFIYQSVTGLYE
TRIHIE SEQ ID NO: 321
MTKFNKNYSIGLDIGVSSVGYAVVTEDYRVPAFKFKVLGNTEKEKIKKNL
IGSTTFVSAQPAKGTRVFRVNRRRIDRRNHRITYLRDIFQKEIEKVDKNF
YRRLDESFRVLGDKSEDLQIKQPFFGDKELETAYHKKYPTIYHLRKHLAD
ADKNSPVADIREVYMAISHILKYRGHFLTLDKINPNNINMQNSWIDFIES
CQEVFDLEISDESKNIADIFKSSENRQEKVKKILPYFQQELLKKDKSIFK
QLLQLLFGLKTKFKDCFELEEEPDLNFSKENYDENLENFLGSLEEDFSDV
FAKLKVLRDTILLSGMLTYTGATHARFSATMVERYEEHRKDLQFKFFIK
QNLSEQDYLDIFGRKTQNGFDVDKETKGYVGYITNKMVLTNPQKQKTIQQ
NFYDYISGKITGIEGAEYFLNKISDGTFLRKLRTSDNGAIPNQIHAYELE
KIIERQGKDYPFLLENKDKLLSILTFKIPYYVGPLAKGSNSRFAWIKRAT
SSDILDDNDEDTRNGKIRPWNYQKLINMDETRDAFITNLIGNDLILLNEK
VLPKRSLIYEEVMLQNELTRVKYKDKYGKAHFFDSELRQNIINGLFKNNS
KRVNAKSLIKYLSDNHKDLNAIEIVSGVEKGKSFNSTLKTYNDLKTIFSE
ELLDSEIYQKELEEIIKVITVFDDKKSIKNYLTKFFGHLEILDEEKINQL
SKLRYSGWGRYSAKLLLDIRDEDTGFNLLQFLRNDEENRNLTKLISDNTL
SFEPKIKDIQSKSTIEDDIFDEIKKLAGSPAIKRGILNSIKIVDELVQII
GYPPHNIVIEMARENMTTEEGQKAKTRKTKLESALKNIENSLLENGKVP
HSDEQLQSEKLYLYYLQNGKDMYTLDKTGSPAPLYLDQLDQYEVDHIIPY
SFLPIDSIDNKVLTHRENNQQKLNNIPDKETVANMKPFWEKLYNAKLISQ
TKYQRLTTSERTPDGVLTESMKAGFIERQLVETRQIIKHVARILDNRFSD
TKIILTKSQLITNFRNTFHIAKIRELNDYHHAHDAYLAVVVGQTLLKVYP
KLAPELIYGHHAHFNRHEENKATLRKHLYSNIMRFFNNPDSKVSKDIWDC
NRDLPIIKDVIYNSQINFVKRTMIKKGAFYNQNPVGKFNKQLAANNRYPL
KTKALCLDTSIYGGYGPMNSALSIIIIAERFNEKKGKIETVKEFHDIFII
DYEKFNNNPFQFLNDTSENGFLKKNNINRVLGFYRIPKYSLMQKIDGTRM
LFESKSNLHKATQFKLTKTQNELFFHMKRLLTKSNLMDLKSKSAIKESQN
FILKHKEEFDNISNQLSAFSQKMLGNTTSLKNLIKGYNERKIKEIDIRDE
TIKYFYDNFIKMFSFVKSGAPKDINDFFDNKCTVARMRPKPDKKLLNATL
IHQSITGLYETRIDLSKLGED SEQ ID NO: 322
MKQEYFLGLDMGTGSLGWAVTDSTYQVMRKHGKALWGTRLFESASTAEER
RMFRTARRRLDRRNWRIQVLQEIFSEEISKVDPGFFLRMKESKYYPEDKR
DAEGNCPELPYALFVDDNYTDKNYHKDYPTIYHLRKMLMETTEIPDIRLV
YLVLHHMMKRGHFLLSGDISQIKEFKSTFEQLIQNIQDEELEWHISLDD
AAIQFVEHVLKDRNLTRSTKKSRLIKQLNAKSACEKAILNLLSGGYFLS
DIFNNKELDESERPKVSFADSGYDDYIGIVEAELAEQYYIIASAKAVYDW
SVLVEILGNSVSISEAKIKVYQKHQADLKTLKKIVRQYMTKEDYKRVFVD
TEEKLNNYSAYIGMTKKNGKKVDLKSKQCTQADFYDFLKKNVIKVIDHKE
ITQEIESEIEKENFLPKQVTKDNGVIPYQVHDYELKKILDNLGTRMPFIK
ENAEKIQQLFEFRIPYYVGPLNRVDDGKDGKFTWSVRKSDARIYPWNFTE
VIDVEASAEKFIRRMTNKCTYLVGEDVLPKDSLVYSKFMVLNELNNRLN
GEKISVELKQRIYEELFCKYRKVTRKKLERYLVIEGIAKKGVEITGIDGD
FKASLTVRFKELHTDVQLSQRAKEAIVLNVVLFGDDKKLLKQRLSKMY
PNLTTGQLKGICSLSYQGWGRLSKTFLEEIITVPAPGTGEVWNIMTALWQT
NDNLMQLLSRNYGFTNEVEEFNTLKKETDLSYKTVDELYVSPAVKRQIWQ
TLKVVKEIQKVMGNAPKRVFVEMAREKQEGKRSDSRKKQLVELYRACKNE
ERDWITELNAQSDQQLRSDKLFLYYIQKGRCMYSGETIQLDELWDNTKYD
IDHIYPQSKTMDDSLNNRVLVKKKNYNAIKSDTYPLSDIQKKMMSFWKML
```

-continued

QQQGFITKEKYVRLVRSDELSAGFIERQIVETRQSTKAVATILKEA
LPDTEIVYVKAGNVSNFRQTYELLKVREMNDLHHAKDAYLNIVVGNAYFV
KFTKNAAWFIRNNPGRSYNLKRMFEFDIERSGEIAWKAGNKGSIVTVKKV
MQKNNILVTRKAYEVKGGLFDQQIMKKGKGQVPIKGNDERLADIEKYGGY
NKAAGTYFMLVKSLDKKGKEIRTIEFVPLYLKLNQIEINHESAIQYLAGR
GLNSPEILLSKIKIDTLFKVDGFKMWLSGRTGNQLIFKGANQLILSHQEA
AILKGVVKYVNRKNENKDAKLSERDGMTEEKLLQLYDTFLDKLSNTVYSI
RLSAQIKTLTEKRAKFIGLSNEDQCIVLNEILHMFQCQSGSANLKLIGGP
GSAGILVMNNNITACKQISVINQSPTGIYEKEIDLIKL

SEQ ID NO: 323
MKKPYSIGLDIGTNSVGWAVVTDDYKVPAKKMKVLGNTDKSHIEKNLLGA
LLFDSGNTAEDRRLKRTARRRYTRRRNRILYLQEIFSEEMGKVDDSFFHR
LEDSFLVTEDKRGERHPIFGNLEEEVKYHENFPTIYHLRQYLADNPEKVD
LRLVYLALAHIIKFRGHFLIEGKFDTRNNDVQRLFQEFLAVYDNTFENSS
LQEQNVQVEEILTDKISKSAKKDRVLKLFPNEKSNGRFAEFLKLIVGNQA
DFKKHFELEEKAPLQFSKDTYEEELEVLLAQIGDNYAELFLSAKKLYDSI
LLSGILTVTDVGTKAPLSASMIQMRYNEHQMDLAQLKQFIRQKLSDKYNEV
FSDVSKDGYAGYIDGKTNQEAFYKYLKGLLNKIEGSGYFLDKIEREDFLR
KQRTFDNGSIPHQIHLQEMRAIIRRQAEFYPPLADNQDRIEKLLTFRIPY
YVGPLARGKSDFAWLSRKSADKITPWNFDEIVDKESSAEAFINRMTNYDL
YLPNQKVLPKHSLLYEKFTVYNELTKVKYTEQGKTAFFDANMKQEIFDG
VFKVYRKVTKDKLMDFLEKEFDEFRIVDLTGLDKENKVFNASYGTYHDLC
KILDKKDFLDNSKNEKILEDIVLTLTLFEDREMIRKRLENYSDLLTKEQVK
KLERRHYTGWGRLSAELIHGIRNKESRKTILDYLIDDGNSRNFMQLIND
DALSFKEEIAKAQVIGETDNLSDSIAGSPAIKKGILQSLKIVDELVK
IMGHQPENIVVEMARENQFTNQGRRNSQQRLKGLTDSIKEFGSQILKEHP
VENSQLQNDRLFLYYLQNGRDMYTGEELDIDYLSQYDIDHIIPQAFIKDN
SIDNRVLTSSKENRGKSDDVPSKDVVRKMKSYWSKLLSAKLITQRKFDNL
TKAERGGLTDDDKAGFIKRQLVETRQITKHVARILDERFNTEDENNKKI
RQVKIVTLKSNLVSNFRKEFELYKVREINDYHHAHDAYLNAVIGKALLGV
YPQLEPEFVYGDYPHFGHKENKATAKKFFYSNIMNFFKKDDVRTDKNGE
IIWKKDEHISNIKKVLSYPQVNIVKKVEEQTGGFSKESILPKGNSDKLIP
RKTKKFYWDTKKYGGFDSPIVAYSILVIADIEKGKSKKLKTVKALVGVTI
MEKMTFERDPVAFLERKGYRNVQEENIIKLPKYSLFKLENGRKRLLASAR
ELQKGNEIVLPNHLGTLLYHAKNIHKVDEPKHLDYVDKHKDEFKELLDVV
SNFSKKYTLAEGNLEKIKELYAQNNGEDLKELASSFINLLTFTAIGAPAT
FKFFDKNIDRKYTSTTEILNATLIHQSITGLYETRIDLNKLGGD

SEQ ID NO: 324
MDKKYSIGLDIGTNSVGWAVITDEYKVPSKKFKVLGNTDRHSIKKNLIGA
LLFDSGETAEATRLKRTARRRYTRRKNRICIYLQEIFSNEMAKVDDSFFHR
LEESFLVEEDKKHERHPIFGNIVDEVAYHEKYPTIYHLRKKLVDSTKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLAKLVRQQLPEKYKEI
FFDQSKNGYAGYIDGGASQEEFYKFIKPILEKMDGTEELLVKLNREDLLR
KQRTFDNGSIPHQIHLGELHAILRRQEDFYPPLKDNREKIEKILTFRIPY
YVGPLARGNSRFAWMTRKSEETITPWNFEEVVDKGASAQSFIERMTNFDK
NLPNEKVLPKHSLLYEFTVYNELTKVKYTEQGRFAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVK
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDGRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKYLDEIIEQISEFSKRVILADANLDKVLSAYNKHRDK
PIREQAENIIHLFTLTNLGAPAAFKYFDTTIDRKYTSTKEVLDATLIHQ
SITGLYETRIDLSQLGGD

SEQ ID NO: 325
MTKPYSIGLDIGTNSVGWAVTTDNYKVPSKKMKVLGNTSKKYIKKNLLGV
LLFDSGITAEGRRLKRTARRRYTRRNRILYLQEIFSTEMATLDDAFFQR
LDDSFLVPDDKRDSKYPIFGNLVEEKAYHDEFPTIYHLRKYLADSTKKAD
LRLVYLALAHMIKYRGHFLIEGEFNSKNNDIQKNFQDFLDTYNAIFESDL
SLENSKQLEEIVDKISKLEKKDRILKLFPGEKNSGIFSEFLKLIVGNQA
DFRKCFNLDEKASLHFSKESYDEDLETLLGYIGDDYLDVKLKAKKLYDAI
LLSGFLTVTDNETEAPLSSAMIKRYNEHKEDLALLKEYIRNISLKTYNEV
FKDDTKNGYAGYIDGKTNQEDFYVYLKKLLAEFEGADYFLEKIDREDFLR
KQRTFDNGSIPYQIHLQEMRAILDKQAKFYPPLAKNKERIEKILTFRIPY
YVGPLARGNSDFAWSIKRNEKITPWNFEDVIDKESSAEAFINRMTSFDL
YLPEEKVLPKHSLLYETFNVYNELTKVRFIAESMRDYQFLDSKQKKDIVR

SEQ ID NO: 326
MKKQFSDYYLGFDIGTNSVGWCVTDLDYNVLRFNKKDDMWGSRLFDEAKT
AAERRVQRNSRRRLKRRKWRLNLLEEIFSDEIMKIDSNFFRRLKESSLWL
EDKNSKEIFTYLNSQLKQKYQYPTIPHLRDELIKNPEKKDIRLIYL
ALHSIFKSRGHFLFEGQNLKEIKNFETLYNNLISFLEDNGINKSIDKDNI
EKLEKIICDSGKGLKDKEKEFKGIFNSDKQLVAIFKLSVGSSVSLNDLFD
TDEYKKEEVEKEKISFREQIYEDDKPIYYSILGEKIELLDIAKSFYDFMV
LNNILSDSNYISEAKVKLYEEHKKDLKNLKYIIRKYNKENYDKLFKDKN
NNYPAYIGLNKEKDKKEVVEKSRLKIDDLIKVIKGYLPKPERIEEKDKTI
FNEILNKIELKTILPKQRISDNGTLPYQIHEVELEKILENQSKYYDFLNY
EENGVSTKDKLLKTFKFRIPYYVGPLNSYHKDKGGNSWIVRKEEGKILPW
NFEQKVDNIRKNKNPIDFLFLYSEYIILNELNK
VQVNDEFLNEENKRKIIDELFKENKKVSEKKFKEYLLVNQIANRTVELKG
IKDSFNSNYVSYIKFKDIFGEKLNLDIYKEISEKSILWKCLYGDDKKIFE
KKIKNEYGDILNKDEIKKINSFKFNTWGRLSEKLLTGIEFINLETGECYS
SVMEALRRTNYNLMELLSSKFTLQESIDNENKEMNEVSYRDLIEESYVSP
SLKRAILQTLKIYEEIKKITGRVPKKVFIEMARGGDESMKNKKIPARQEQ
LKKLYDSCGNDIANFSIDIKEMKNSLSSYDNNSLRQKKLYLYYLQFGKCM
YTGREIDLDRLLQNNDTYDIDHIYPRSKVIKDDSFDNLVLVLKNENAEKS
NEYPVKKEIQEKMKSFWRFLKEKNPISDEKYKRLTGKDDPELRGFMARQL
VNVRQTTKEVGKILQQIEPEIKIVYSKAEIASSFREMFDFIKVRELNDTH
HAKDAYLNIVAGNVYNTKFTEKPYRYLQEIKENYDVKKIYNYDIKNAWDK
ENSLEIVKKNMEKNTVNITRFIKEEKGELFNLNPIKKGETSNEIISIKPK
LYDGKDNKLNEKYGYYTSLKAAYFIYVEHEKKNKKVKTFERITRIDSTLI
KNEKNLIKYLVSQKKLLNPKIIKKIYKEQTLIIDSYPYTFTGVDSNKKVE
LKNKKQLYLEKKYEQILKNALKFVEDNQGEETEENYKFIYLKKRNNNEKNE
TIDAVKERYNIEFNEMYDKFLEKLSSKDYKNYINNKLYTNFLNSKEKFKK
LKLWEKSLILREFLKIFNKNTYGKYEIKDSQTKEKLFSFPEDTGRIRLGQ
SSLGNNKELLEESVTGLFVKKIKL

SEQ ID NO: 327
MKNYTIGLDIGVASVGWVCIDENYKILNYNNRHAFGVHEFESAESAAGRR
LKRGMRRRYNRRKKRLQLLQSLFDSYITDSGFFSKTDSQHFWKNNEFEN
RSLTEVLSSLRISSRKYPTIYHLRSDLIESNKKMDLRLVYLALHNLVKYR
GHFLQEGNWSEAASAEGMDDQLLELVTRYAELENLSPLDLSESQWKAAET
LLLNRNLTKTDQSKELTAMFGKEYEPFCKLVAGLGVSLHQLFPSSEQALA
YKETKTKVQLSNENVEEVMELLLEEESALLEAVQPFYQQVVLYELLKGET
YVAKAKVSAFKQYQKDMASLKNLLDKTFGEKVYRSYFISDKNSQREYQKS
HKVEVLCKLDQFNKEAKFAETFYKDLKKLLEDKSKTSIGTTEKDEMLRII
KAIDSNQFLQKQKGIQNAAIPHQNSLYEAEKILRNQQAHYPFITTEWIEK
VKQILAFRIPYYIGPLKDTTQSPFSWVERKGDAPITPWNFDEQIDKAAS
AEAFISRMRKTCTYLKGQEVLPKSSLTYERFEVLNELNGIQLRTTGAESD
FRHRLSYEMKCWIIDNVFKQYKTVSTKRLLQELKKSPYADELYDEHTGEI
KEVFGTQKENAFATSLSGYISMKSILGAVVDDNPAMTEELIYWIAVFEDR
EILHLKIQEKYPSITDVQRQKLALVKLPGWGRFSRLLIDGLPLDEQGQSV
LDHMEQYSSVFMKNLKGFGLEKKIQKMMNQHQVDGTKKIRYEDIEELAG
SPALKRGIWRSVKIVEELVSIFGEPANIVLEVARDEGKRKTKSRKDQWE
ELTKTTLKNDPDLKSFIGEIKSQGDQRFNEQRFWLYVTQQGKCLYTGKAL
DIQNLSMYEVDHILPQNFVKDDSLDNLALVMPEANQRKNQVGQNKMPLEI
IEANQQYAMRTLWERLHELKLISSGKLGRLKKPSFDEVDKDKFIARQYK
TRQIIKHVRDLLDERFSKSDIHLVKAGIVSKFRRFSEIPKIRDYNNKHHA
MDALFAAALIQSILGKYGKNFLAFDLSKKDRQKQWRSVKGSNKEFFLFKN
FGNLRLQSPVTGEEVSGVEYMKHVYFELPWQTTKMTQTGDGMFYKESIFS
PKVKQAKVYSLFKDTVHDEVKNHSICLVEFTFMKKEKEVQETKFIDLKV
IEHHQFLKEPESQLAKFLAEKETNSPIIHARIIRTIPKYQKIWIEHFPYY
FISTRELHNARQFEISYELMEKVKQLSERSSVEELKIVFGLLIDQMNDNY
PIYTKSSIQDRVQKFVDTQLYDFKSFEIGFEELKKAVAANAQRSDTFGSR
ISKKPKPEEVAIGYESITGLKYRKPRSVVGTKR

SEQ ID NO: 328
MKKEIKDYFLGLDVGTGSVWAVTDTDYKLLKANRKDLWGMRCFETAETA
EVRRLHRGARRRIERRKKRIKLLQELFSQEIAKTDEGFFQRMKESPFYAE
DKTILQENTLFNDKFADKTYHKAYPTINHLIKAWIENKVKPDPRLLYLA

CHNIIKKRGHFLFEGDFDSENQFDTSIQALFEYLREDMEVDIDADSQKVK
EILKDSSLKNSEKQSRLNKILGLKPSDKQKKAITNLISGNKINFADLYDN
PDLKNDAEKNSISFSKDDFDALSDDLASILGDSFELLLKAKAVYNCSVLSK
VIGDEQYLSFAKVKIYEKHKTDLTKLKNVIKKHFPKDYKKVFGYNKNEKN
NNNYSGYVGVCKTKSKKLIINNSVNQEDFYKFLKTILSAKSEIKEVNDIL
TEIETGTFLPKQISKSNAEIPYQLRKMELEKILSNAEKHFSFLKQKDEKG
LSHSEKIIMLLTFKIPYYIGPINDNHKKFFPDRCWVVKKEKSPSGKTTPW
NFFDHIDKEKTAEAFITSRTNFCTYLVGESVLPKSSLLYSEYTVLNEINN
LQIIIDGKNICDIKLKQKIYEDLFFKYKKITQKQISTFIKHEGICNTSK
VIILGIDKECTSSLKSYIELKNIFGKQVDEISTKNMLEEIIRWATIYDEG
EGKTILKTKIKAEYGKYCSDEQIKKILNLKFSGWGRLSRKFLETVTSEMP
GFSEPVNIITAMRETQNNLMELLSSEFTFTENIKKINSGFEDAEKQFSYD
GLVKPLFLSPSVKKMLWQTLKLVKEISHITQAPPKKIFIEMAKGAELEPA
RTKTRLKILQDLYNNCKNDADAFSSEIKDLSGKIENEDNLRLRSDKLYLY
YTQLGKCMYCGKPIEIGHVFDTSNYDIDHIYPQSKIKDDSISNRVLVCSS
CNKNKEDKYPLKSEIQSKQRGFWNFLQRNNFISLEKLNRLTRATPISDDE
TAKFIARQLVETRQATKVAAKVLEKMFPETKIVYSKAETVSMFRNKFDIV
KCREINDFHHAHDAYLNIVQNVYNTKFTNNPWNFIKEKRDNPKIADTYN
YYKVFDYDVKRNNITAWEKGKTIITVKDMLKRNTPIYTRQAACKKGELFN
QTIMKKGLGQHPLKKEGPFSNISKYGGYNKVSAAYYTLIEYEEKGNKIRS
LETIPLYLVKDIQKDQDVLKSYLTDLLGKKEFKILVPKIKINSLLKINGF
PCHITGKTNDSFLLRPAVQFCCSNNEVLYFKKIIRFSEIRSQREKIGKTI
SPYEDLSFRSYIKENLWKKTKNDEIGEKEFYDLLQKKNLEIYDMLLTKHK
DTIYKKRPNSATIDILVKGKEKFKSLIIENQFPEVILEILKLFSATRNVSD
LQHIGGSKYSGVAKIGNKISSLDNCILIYQSITGIFEKRIDLLKV

SEQ ID NO: 329

MEGQMKNNGNNLQQGNYYLGLDVGTSSVGWAVTDTDYNVLKFRGKSMWGA
RLFDEASTAEERRTHRGNRRRLARRKYRLLLLEQLFEKEIRKIDDNFFVR
LHESNLWADDKSKPSKFLLFNDTMFTDKDYLKKVKPTIYHLRSDLIHNSTE
HDIRLVFLALHHLIKYRGHFIYDNSANGDVKTLDEAVSDFEEYLNENDIE
FNIENKKEFINVLSDKHLTKKEKKISLKKLYGDITDSENINISVLIEMLS
GSSISLSNLFKDIEFDGKQNLSLDSDIEETLNDVVDILGDNIDLLIHAKE
VYDIAVLTSSLGKHKYLCDAKVFLEKNKKDLMILKKYIKKNHPEDYKKI
FSSPTEKKNYAAYSQTNSKNVCSQEEFCLFIKPYIRDMVKSENEDEVRIA
KEVEDKSFLTKLKGTNNSVVPYQIHERELNQIILKNIVAYLPPMNDEQEDI
SVVDKIKLIFKFKIPYYVGPLNTKSTRSWVYRSDEKIYPWNFSNVIDLDK
TAHEFMNRLIGRCTYTNDPVLPMDSLLYSKYNVLNEINPIKVNGKAIPVE
VKQAIYTDLFENSKKKVTRKSIYIYLLRNGYIEKEDIVSGIDIEIKSLK
SHHDFTQIVQENKCTPEEIERIIKGILVYSDDKSMLRRWLKNNIKGLSEN
DVKYLAKLNYKEWGRLSKTLLTDIYTINPEDGEACSILDIMWNTNATLME
ILSNEKYQFKQNIENYKAENYDEKQNLHEELDDMYISPAARRSIWQALRI
VDEIVDIKKSAPKKIFIEMAREKKSAMKKRTESRKDTLLELYKSCKSQL
DGFYDEELFEKLSNESNSRLRRDQLYLYYTQMGRSMYTGKRIDFDKLIND
KNTYDIDIHYPRSKIKDDSITNRVLVEKDINGEKTDIYPISEDIRQKMQP
FWKILKEKGLINEEKYKRLTRNYELTDEELSSFVARQLVETQQSTKALAT
LLKKEYPSAKIVYSKAGNVSEFRNRKDLKPKFREINDLHHAKDAYLNIV
VGNVYDTKFTEKFFNNIRNENYSLKRVFDFSVPGAWDAKGSTFNTIKKYM
AKNNPIIAFAPYEVKGELFDQQIVPKGKGQFPIKQGKDIEKYGGYNKLSS
AFLFAVEYKGKKARERSLETVYIKDVELYLQDPIKYCESVLGLKEPQIIK
PKILMGSLFSINNKKLVVTGRSGKQYVCHHIYQLSINEDSQYLKNIAKY
LQEEPDGNIERQNILNITSVNNIKLFDVLCTKFNSNTYEIILLNSLKNDVN
EGREKFSELDILEQCNILLQLLKAFKCNRESSNLEKLNNKKQAGVIVIPH
LFTKCSVFKVIHQSITGLFEKEMDLLK

SEQ ID NO: 330

MGRKPYILSLDIGTGSVGYACMDKGFNVLKYHDKDALGVYLFDGALTAQE
RRQFRTSRRRKNRRIKRLGLLQELLAPLVQNPNFYQFQRQFAWKNDNMDF
KNKSLSEVLSFLGYESKKYPTIYHLQKLLDIRPFFKRLSIINKKLIFQDEDNKY
YRGHFLFDHLKIENLTNNDNMHDFVELIETYENLNNIKLNLDYEKTKVIY
EILKDNEMTKNDRAKRVKNMEKKLEQFSIMLLGLKFNEGKLFNHADNAEE
LKGANQSHTFADNYEENLTPFLTVEQSEFIERANKIYLSLTLQDDILKGKK
SMAMSKVAAYDKFRNELKQVKDIVYKADSTRTQFKKIFVSSKKSLKQYDA
TPNDQTFSSLCLFDQYLIRPKKQYSLILKELKKIIPQDSELYFEAENDTL
LKVLNTTDNASIPMQINLYEAETILRNQQKYHAEITDEMIEKVLSLIQFR
IPYYVGPLVNDHTASKFGWMERKSNESIKPWNFDEVVDRSKSATQFIRRM
TNKCSYLINEDVLPKNSLLYQEMEVLNELNATQIRLQTDPKNRKYRMMPQ
IKLFAVEHIFKKYKTVSHSKFLEIMLNSNHRENFMNHGEKLSIFGTQDDK
KFASKLSSYQDMTKIFGDIEGKRAQIEEIIQWITIFEDKKILVQKLKECY
PELTSKQINQLKKLNYSGWGRLSEKLLTHAYQGHSIIELLRHSDENFMEI
LTNDVYGFQNFIKEENQVQSNKIQHQDIANLTTSPALKKGIWSTIKLVRE
LTSIFGEPEKIIMEFATEDQQKGKKQKSRKQLWDDNIKKNKLKSVDRYI
IDVANKLNNEQLQQEKLWLYLSQNGKCMYSGQSIDLDALLSPNATKHYE
VDHIFPRSFIKDDSIDNKVLVIKKMNQTKGDQVPLQFIQQPYERIAYWKS
LNKAGLISDSKLHKLMKPEFTAMDKEGFIQRQLVETRQISVHVRDFLKEE
YPNTKVIPMKAKMVSEFRKKFDINQMDAHHAIDAYLNGVIVRDKIQGAQL
AYPNVDLFDFNFKWEKVREKWKALGEFNTKQKSRELFFFFKKLEKMEVSQG
ERLISKIKLDMNHFKINYSRKLANIPQQFYNQTAVSPKTAELKYESNKSN
EVVYKGLTPYQTYVVAIKSVNKKGKEKMEYQMIDHYVFDFYKFQNGNEKE
LALYLAQRENKDEVLDAQIVYSLNKGDLLYINNHPCYFVSRKEVINAKQF
ELTVEQQLSLYNVMNNKETNVEKLLIEYDFIAEKVINEYHHYLNSKLKEK

SEQ ID NO: 331

MAKILGLDLGTNSIGWAVVERENIDFSLIDKGVRIFSEGVKSEKGIESSR
AAERTGYRSARKIKYRRKLRKYETLKVLSLNRMCPLSIEEVEEWKKSGFK
DYPLNPEFLKWLSTDEESNVNPYFFRDRASKHKVSLFELGRAFYHIAQRR
GFLSNRLDQSAEGILEEHCPKIEAIVEDLISIDEISTNITDYFFETGILD
SNEKNGYAKDLDEGDKKLVSLYKSLLAILKKNESDFENCKSEIIERLNKK
DVLGKVKGKIKDISQAMLDGNYKTLGQYFYSLYSKEKIRNQYTSREEHYL
SEFITICKVQGIDQINEEEKINEKKFDGLAKDLYKAIFFQRPLKSQKGLI
GKCSFEKSKSRCAISHPDFEEYRMWTYLNTIKIGTQSDKKLRFLTQDEKL
KLVPKFYRKNDFNFDVLAKELIEKGSSFGFYKSSKKNDFFYWFNYKPTDT
VAACQVAASLKNAIGEDWKTKSFKYQTINSNKEQVSRTVDYKDLWHLLTV
ATSDVYLYEFAIDKLGLDEKNAKAFSKTKLKKDFASLSLSAINKILPYLK
EGLLYSHAVFVANIENIVDENIWKDEKQRDYIKTQISEEIIENYTLEKSRF
EIINGLLKEYKSENEDGKRVYYSKEAEQSFENDLKKKLVLFYKSNEIENK
EQQETIFNELLPIFIQQLKDYFEIKFJJIQRLDQKVLIFLKGKNETGQIFCTE
EKGTAEEEKKKIKNRLKKLYHPSDIEKFKKKIIKDEFGNEKIVLGSPLTP
SIKNPMAMRALHQLRKVLNALILEGQIDEKTIIHIEMARELNDANKRKGI
QDYQNDNKKFREDAIKEIKKLYFEDCKKEVEPTEDDILRYQLWMEQNRSE
IYEEGKNISICDIIGSNPAYDIEHTIPRSRSQDNSQMNKTLCSQRFNREV
KKQSMPIELNNHLEILPRIAHWKEEADNLTREIEIISRSIKAAATKEIKD
KKIRRRHYLTLKRDYLQGKYDRFIWEEPKVGFKNSQIPDTGIITKYAQAY
LKSYFKKVESVKGGMVAEFRKIWGIQESFIDENGMKHYKVKDRSKHTHHT
IDAITIACMTKEKYDVLAHAWTLEDQQNKKEARSIIEASKPWKTFKEDLL
KIEEEILVSHYTPDNVKKQAKKIVRVRGKKQFVAEVERDVNGKAVPKKAA
SGKTIYKLDGEGKKLPRLQQGDTIRGSLHQDSIYGAIKNPLNTDEIKVYI
RKDLESIKGSDVESIVDEVVKEKIKEAIANKVLLLSSNAQQKNKLVGTVW
MNEEKRIAINKVRIYANSVKNTLRLLKFEFLFNSKDLSEKDILELISLNIINSGI
ISKKEEETTHRINLFANRKELKGNETKSRYRKVFKKLGFDGEYILNHPSK
LNRLWHSDYSNDYADKEKTEKSILSSLGWKNRNGKWEKSKNYDVFNLPLE
VAKAIANLPPLKKEYGSYSALAIRKMLVVMRDGKYWQHPDQIAKDQENTS
LMLFDKNLLQLTNNQRKVLNKYLLTLAEVQKRSTLIKQKLNEIEHNPYKL
ELVSDQDLEKQVLKSFLEKKNESDYLKGLKTYQAGYLIYGKHSEKDVPIV
NSPDELGEYIRKKLPNNSLRNPIVEQVIRETIFIVRDVWKSFGIIDEIHI
ELGRELKNNSEERKKTSESQEKNFQEKERARKLLKELLNSSNFEHYDENG
NKIFSSFTVNPNPDSPLDIEKFRIWKNQSGLTDEELNKKLKDEKIPTEIE
VKKYILWLTQKCRSPYTGKIIPLSKLFDSNVYEIEHIIPRSKMKNDSTNN
LVICELGVNKAKGDRLAANFISESNGKCKFGEVEYTLLKYGDYLQYCKDT
FKYQKAKYKNLLATEPPEDFIERQINDTRYIGRKLAELLTPVVKDSKNII
FTIGSITSELKITWGLNGVLKDKLPRFKRLESIINKKLIFQDEDDPNKY
HFDLSINPQLDKEGLKRLDRHHALDATIIAATTREHVRYLNSLNAADND
EEKREYFLSLCNHKIRDFKLPWENFTSEVKSKLLSCVVSYKESKPILSDP
FNKYLKWEYKNGKWQKVFAIQIKNDRWKAVRRSMFKEPIGTVWIKKIKEV
SLKEAIKIQAIWEEVKNDPVRKKKEKYIYDDYAQKVIAKIVQELGLSSSM
RKQDDKELKNKFINEAKVSAGVNKNLNTTNKTIYNLEGRFYEKIKVAEYVL
YKAKRMPLNKKEYIEKLSLQKMFNDLPNFILEKSILDNYPEILKELESDN
KYIIEPHKKNNPVNRLLLEHILEYHNNPKEAFSTEGLEKLNKKAINKIGK
PIKYITRLDGDINEEIFRGAVFETDKGSNVYFVMYENNQTKDREFLKPN
PSISVLAIEHDNKIDFFAPNRLGFSRILLSPGDLVYVPTNDQYVLIKDN
SSNETIINWDDNEFISNRIYQVKKFTGNSCYFLKNDIASLILSYSASNGV
GEFKGSQNISEYSVDDPPIRIKDVCIKIRVDRLGNVRPL

SEQ ID NO: 332

MEFKKVLGLDIGTNSIGCALLSLPKSIQDYGKGGRLEWLTSRVIPLDADY
MKAFIDGKNGLPQVITPAGKRRQKRGSRRLKHRYLKRRSRLIRVFPKTLNW
LPEDFPLDNPKRIKETISTEGKFSFRISDIYVPISDESYREFYREFGYPEN
EIEQVIEEINFRRKTKGKNKNPMIKLLPEDWVVYYLRKKALIKPTTKEEL
IRIIYLFNQRRGFKSSRKDLTETAILDYDEFAKRLAEKEKYSAENYETKF
VSITKVKEVVELKTDGRKGKKRFKVILEDSRIEPYEIERKEKPDWEGKEY
TFLVTQKLEKGKFKQNKPDLPKEEDWALCCTALDNRMGSKHPGEFFFDEL
LKAFKEKRGYKIRQYPVNRWRYKKELEFIWTKQCQLNPELNNLNINKEIL
RKLATVYLYPSQSKFFGPKIKEFENSDVLHIISEDIIYYQRDLKSQKSLIS
ECRYEKRKGIDGEIYGLKCIPKSSPLYQEFRIWQDIHNIKVIRKESEVNG
KKKINIEDTQLYINENIKEKLFELFNSKDLSEKDILELISLNIINSGI
ISKKEEETTHRINLFANRKELKGNETKSRYRKVFKKLGFDGEYILNHPSK
LNRLWHSDYSNDYADKEKTEKSILSSLGWKNRNGKWEKSKNYDVFNLPLE
VAKAIANLPPLKKEYGSYSALAIRKMLVVMRDGKYWQHPDQIAKDQENTS
LMLFDKNLLQLTNNQRKVLNKYLLTLAEVQKRSTLIKQKLNEIEHNPYKL
ELVSDQDLEKQVLKSFLEKKNESDYLKGLKTYQAGYLIYGKHSEKDVPIV
NSPDELGEYIRKKLPNNSLRNPIVEQVIRETIFIVRDVWKSFGIIDEIHI
ELGRELKNNSEERKKTSESQEKNFQEKERARKLLKELLNSSNFEHYDENG
NKIFSSFTVNPNPDSPLDIEKFRIWKNQSGLTDEELNKKLKDEKIPTEIE
VKKYILWLTQKCRSPYTGKIIPLSKLFDSNVYEIEHIIPRSKMKNDSTNN
LVICELGVNKAKGDRLAANFISESNGKCKFGEVEYTLLKYGDYLQYCKDT
FKYQKAKYKNLLATEPPEDFIERQINDTRYIGRKLAELLTPVVKDSKNII
FTIGSITSELKITWGLNGVLKDKLPRFKRLESIINKKLIFQDEDDPNKY
HFDLSINPQLDKEGLKRLDRHHALDATIIAATTREHVRYLNSLNAADND
EEKREYFLSLCNHKIRDFKLPWENFTSEVKSKLLSCVVSYKESKPILSDP
FNKYLKWEYKNGKWQKVFAIQIKNDRWKAVRRSMFKEPIGTVWIKKIKEV
SLKEAIKIQAIWEEVKNDPVRKKKEKYIYDDYAQKVIAKIVQELGLSSSM
RKQDDKELKNKFINEAKVSAGVNKNLNTTNKTIYNLEGRFYEKIKVAEYVL
YKAKRMPLNKKEYIEKLSLQKMFNDLPNFILEKSILDNYPEILKELESDN
KYIIEPHKKNNPVNRLLLEHILEYHNNPKEAFSTEGLEKLNKKAINKIGK
PIKYITRLDGDINEEIFRGAVFETDKGSNVYFVMYENNQTKDREFLKPN
PSISVLAIEHDNKIDFFAPNRLGFSRILLSPGDLVYVPTNDQYVLIKDN
SSNETIINWDDNEFISNRIYQVKKFTGNSCYFLKNDIASLILSYSASNGV
GEFKGSQNISEYSVDDPPIRIKDVCIKIRVDRLGNVRPL

SEQ ID NO: 333

MKHILGLDLGTNSIGWALIERNIEEKYGKIIGMGSRIVPMGAELSKFEQG
QAQTKNADRRTNRGARRLNKRYKQRRNKLIYILQKLDMLPSQIKLKEDFS
DPNKIDKITILPISKKQEQLTAFDLVSLRVKALTEKVGLEDLGKIIYKYN
QLRGYAGGSLEPEKEDIFDEEQSKDKKNSFIAFSKIVFLGEQPEEIFKN
KKLNRRAIIVETEEGNFEGSTFLENIKVGDSLELLINISASKSGDTITIK
LPNKTNWRKKMENIENQLKEKSKEMGREFYISEFLLELLKENRWAKIRNN
TILRARYESEFEAIWNEQVKHYPFLENLDKKTLIEIVSFIFPGEKESQKK
YRELGLEKGLKYIIKNQVVFYQRELKDQSHLISDCRYEPNEKAIAKSHPV
FQEYKVWEQINKLVNTKIEAGTNRKGEKKYKYIDRPIPTALKEWIFEEL

-continued

QNKKEITFSAIFKKLKAEFDLREGIDFLNGMSPKDKLKGNETKLQLQKSL
GELWDVLGLDSINRQIELWNILYNEKGNEYDLTSDRTSKVLEFINKYGNN
IVDDNAEETAIRISKIKFARAYSSLSLKAVERILPLVRAGKYFNNDFSQQ
LQSKILKLLNENVEDPFAKAAQTYLDNNQSVLSEGGVGNSIATILVYDKH
TAKEYSHDELYKSYKEINLLKQGDLRNPLVEQIINEALVLIRDIWKNYGI
KPNEIRVELARDLKNSAKERATIHKRNKDNQTINNKIKETLVKNKKELSL
ANIEKVKLWEAQRHLSPYTGQPIPLSDLFDKEKYDVDHIIPISRYFDDSF
TNKVISEKSVNQEKANRTAMEYFEVGSLKYSIFTKEQFIAHVNEYFSGVK
RKNLLATSIPEDPVQRQIKDTQYIAIRVKEELNKIVGNENVKTTTGSITD
YLRNHWGLTDKFKLLLKERYEALLESEKFLEAEYDNYKKDFDSRKKEYEE
KEVLFEEQELTREEFIKEYKENYIRYKKNKLIIKGWSKRIDHRHHAIDAL
IVACTEPAHIKRLNDLNKVLQDWLVEHKSEFMPNFEGSNSELLEEILSLP
ENERTEIFTQIEKFRAIEMPWKGFPEQVEQKLKEIIISHKPKDKLLLQYN
KAGDRQIKLRGQLHEGTLYGISQGKEAYRIPLTKFGGSKFATEKNIQKIV
SPFLSGFIANHLKEYNNKKEEAFSAEGIMDLNNKLAQYRNEKGELKPHTP
ISTVKIYYKDPSKNKKKKDEEDLSLQKLDREKAFNEKLYVKTGDNYLFAV
LEGEIKTKKTSQIKRLYDIISFFDATNFLKEEFRNAPDKKTFDKDLLFRQ
YFEERNKAKLLFTLKQGDFVYLPNENEEVILDKESPLYNQYWGDLKERGK
NIYVVQKFSKKQIYFIKHTIADIIKKDVEFGSQNCYETVEGRSIKENCFK
LEIDRLGNIVKVIKR

SEQ ID NO: 334
MHVEIDFPHFSRGDSHLAMNKNEILRGSSVLYRLGLDLGSNSLGWFVTHL
EKRGDRHEPVALGPGGVRIFPDGRDPQSGTSNAVDRRMARGARKRRDRFV
ERRKELIAALIKYNLLPDDARERRALEVLDPYALRKTALTDTLPAHHVGR
ALFHLNQRRGFQSNRKTDSKQSEDGAIKQAASRLATDKGNETLRAFADM
HLRKSYEDRQTAIRAELVRLGKDHLTGNARKKIWAKVRKRLFGDEVLPRA
DAPHGVRARATITGTKASYDYYPTRDMLRDEFNAIWAGQSAHHATITDEA
RTEIEHIIFYQRPLKPAIVGKCTLDPATRPFKEDPEGYRAPWSHPLAQRF
RILSEARNLEIRDTGKGSRRLTKEQSDLVVAALLANREVKFDKLRTLLKL
PAEARFNLESDRRAALDGDQTAARLSDKKGFNKAWRGFPPPERQIAIVARL
EETEDENELIAWLEKECALDGAAAARVANTTLPDGHCRLGLRAIKKIVPI
MQDGLDEDGVAGAGYHIAAKRAGYDHAKLPTGEQLGRLPYYGQWLQDAVV
GSGDARDQKEKQYGQFPNPTVHIGLGQLRRVVNDLIDKYGPPTEISIEFT
RALKLSEQQKAERQREQRRNQDKNKARAEELAKFGRPANPRNLLKMRLWE
ELAHDPLDRKCVYTGEQISIERLLSDEVDIDHILPVAMTLDDSPANKIIC
MRYANRHKRKQTPSEAFGSSPTLQGHRYNWDDIAARATGLPRNKRWRFDA
NAREEFDKRGGFLARQLNETGWLARLAKQYLGAVTDPNQIWVVPGRLTSM
LRGKWGLNGLLPSDNYAGVQDKAEEFLASTDDMEFSGVKNRADHRHHAID
GLVTALTDRSLLWKMANAYDEEHEKFVIEPPWPTMRDDLKAALEKMVVSH
KPDHGIEGKLHEDSAYGFVKPLDATGLKEEEAGNLVYRKAIESLNENEVD
RIRDIQLRTIVRDHVNVEKTKGVALADALRQLQAPSDDYPQFKHGLRHVR
ILKKEKGDYLVPIANRASGVAYKAYSAGENFCVEVFETAGGKWDGEAVRR
FDANKKNAGPKIAHAPQWRDANEGAKLVMRIHKGDLIRLDHEGRARIMVV
HRLDAAAGRFKLADHNETGNLDKRHATNNDIDPFRWLMASYNTLKKLAAV
PVRVDELGRVWRVMPN

SEQ ID NO: 335
METTLGIDLGTNSIGLALVDQEEHQILYSGVRIFPEGINKDTIGLGEKEE
SRNATRRAKRQMRRQYFRKKLRKAKLLELLIAYDMCPLKPEDVRRWKNWD
KQQKSTVRQFPDTPAFREWLKQNPYELRKQAVTEDVTRPELGRILYQMIQ
RRGFLSSRKGKEEGKIFTGKDRMVGIDETRKNLQKQTLGAYLYDIAPKNG
EKYRFRTERVRARYTLRDMYIREFEIIWQRQAGHLGLAHEQATRKKNIFL
EGSATNVRNSKLITHLQAKYGRGHVLIEDTRITVTFQLPLKEVLGGKIEI
EEEQLKFKSNESVLFWQRPLRSQKSLLSKCVFEGRNFYDPVHQKWIIAGP
TPAPLSHPEFEEFRAYQFINNIIYGKNEHLTAIQREAVFELMCTESKDFN
FEKIPKHLKLFEKFNFDDTTKVPACTTISQLRKLFPHPVWEEKREEIWHC
FYFYDDNTLLFEKLQKDYALQTNDLEKIKKIRLSESYGNVSLKAIRRINP
YLKKGYAYSTAVLLGGIRNSFGKRFEYFKEYEPEIEKAVCRILKEKNAEG
EVIRKIKDYLVHNRFGFAKNDRAFQKLYHHSQAITTQAQKERLPETGNLR
NPIVQQGLNELRRTVNKLLATCREKYGPSFKFDHIHVEMGRELRSSKTER
EKQSRQIRENEKKNEAAKVKLAEYGLKAYRDNIQKYLLKEIEEKGGYVC
CPYTGKTLNISHTLGSDNSVQIEHIIPYSISLDDSLANKTLCDATFNREK
GELTPYDFYQKDPSPEKWGASSWEEIEDRAFRLLPYAKAQRFIRRKPQES
NEFISRQLNDTRYISKKAVEYLSAICSDVKAFPGQLTAELRHLWGLNNIL
QSAPDITFPLPVSATENHREYYVITNEQNEVIRLFPKQGETPRTEKGELL
LTGEVERKVFRCKGMQEFQTDVSDGKYWRRIKLSSSVTWSPLFAPKPISA
DGQIVLKGRIEKGVFVCNQLKQKLKTGLPDGSYWISLPVISQTFKEGESV
NNSKLTSQQVQLFGRVREGIFRCHNYQCPASGADGNFWCTLDTDTAQPAF
TPIKNAPPGVGGGQIILTGDVDDKGIFHADDDLHYELPASLPKGKYYGIF
TVESCDPTLIPIELSAPKTSKGENLIEGNIWVDEHTGEVRFDPKKNREDQ
RHHAIDAIVIALSSQSLFQRLSTYNARRENKKRGLDSTEHFPSPWPGFAQ
DVRQSVVPLLVSYKQNPKTLCKISKTLYKDGKKIHSCGNAVRGQLHKETV
YGQRTAPGATEKSYHIRKDIRELKTSKHIGKVVDITIRQMLLKHLQENYH
IDITQEFNIPSNAFFKEGVYRIFLPNKHGEPVPIKKIRMKEELGNAERLK
DNINQYVPNRNNHHVMIYQDADGNLKEEIVSFWSVIERQNQGQPIYQLPR
EGRNIVSILQINDTFLIGLKEEEPEVYRNDLSTLSKHLYRVQKLSGMYYT
FRHHLASTLNNEREEFRIQSLEAWKRANPVKVQIDEIGRITFLNGPLC

SEQ ID NO: 336
MESSQILSPIGIDLGGKFTGVCLSHLEAFAELPNHANTKYSVILIDHNNF
QLSQAQRRATRHRVRNKKRNQFVKRVALQLFQHILSRDLNAKEETALCHY
LNNRGYTYVDTDLDEYIKDETTINLLKELLPSESEHNFIDWFLQKMQSSE
FRKILVSKVEEKKDDKELKNAVKNIKNFITGFEKNSVEGHRHRKVYFENI
KSDITKDNQLDSIKKKIPSVCLSNLLGHLSNLQWKNLHRYLAKNPKQFDE
QTFGNEFLRMLKNFRHLKGSQESLAVRNLIQQLEQSQDYISILEKTPPEI
TIPPYEARTNTGMEKDQSLLLNPEKLNNLYPNWRNLIPGIIDAHPFLEKD
LEHTKLRDRKRIISPSKQDEKRDSYILQRYLDLNKKIDKFKIKKQLSFLG
QGKQLPANLIETQKEMETHFNSSLVSVLIQIASAYNKEREDAAQGIWFDN
AFSLCELSNINPPRKQKILPLLVGAILSEDFINNKDKWAKFKIFWNTHKI
GRTSLKSKCKEIEEARKNSGNAFKIDYEEALNHPEHSNNKALIKIIQTIP
DIIQAIQSHLGHNDSQALIYHNPFSLSQLYTILETKRDGFHKNCVAVTCE
NYWRSQKTEIDPEISYASRLPADSVRPFDGVLARMMQRLAYEIAMAKWEQ
IKHIPDNSSLLIPIYLEQNRFEFEESFKKIGSSSDKTLEQAIEKQNIQW
EEKFQRIINASMNICPYKGASIGGQGEIDHIYPRSLSKKHFGVIFNSEVN
LIYCSSQGNREKKEEHYLLEHLSPLYLKHQFGTDNVSDIKNFISQNVANI
KKYISFHLLTPEQQKAARHALFLDYDDEAFKTITKFLMSQQKARVNGTQK
FLGKQIMEFLSTLADSKQLQLEFSIKQITAEEVHDHRELLSKQEPKLVKS
RQQSFPSHAIDATLTMSIGLKEFPQFSQELDNSWFINHLMPDEVHLNPVR
SKEKYNKPNISSTPLFKDSLYAERFIPVWVKGETFAIGFSEKDLFERKPS
NKEKLFTLLKTYSTKNPGESLQELQAKSKAKWLYFPINKTLALEFLHHYF
HKEIVTPDDTTVCHPINSLRYYTKKESITVKILKEPMPVLSVKFESSKKN
VLGSFKHTIALPATKDWERLFNHPNFLAKLANPAPNPKEFNEFIRKYFLS
DNNPNSDIPNNGHNIKPQKHKAVRKVFSLPVIPGNAGTMMRIRRKDNKGQ
PLYQLQTIDDTPSMGIQINEDRLVKQEVLMDAYKTRNLSTIDGINNSEGQ
AYATFDNWLTLPVSTFKPEIIKLEMKPHSKTRRYIRITQSLADFIKTIDE
ALMIKPSDSIDDPLNMPNEIVCKNKLFGNELKPRDGKMKIVSTGKIVTYE
FESDSTPQWIQTLYVTQLKKQP

SEQ ID NO: 337
MKKIVGLDLGTNSIGWALINAYINKEHLYGIEACGSRIIPMDAAILGNFD
KGNSISQTADRTSYRGIRRLRERHLLRRERLHRILDLLGFLPKHYSDSLN
RYGKFLNDIECKLPWVKDETGSYKFIFQESFKEMLANFTEHHPILIANNK
KVPYDWTIYYLRKKALTQKISKEELAWILLNFNQKRGYYQLRGEEEETPN
KLVEYYSLKVEKVEDSGERKGKDTWYNVHLENGMIYRRTSNIPLDWEGKT
KEFIVTTDLEADGSPKKDKEGNIKRSFRAPKDDDWTLIKKKTEADIDKIK
MTVGAYIYDTLLQKPDQKIRGKLVRTIERKYYKNELYQILKTQSEFHEEL
RDKQLYIACLNELYPNNEPRRNSISTRDFCHLFIEDIIFYQRPLKSKKSL
IDNCPYEENRYIDKESGEIKHASIKCIAKSHPLYQEFRLWQFIVNLRIYR
KETDVDVTQELLPTEADYVTLFEWLNEKKEIDQKAFFKYPPFGFKKTTSN
YRWNYVEDKPYPCNETHAQIIARLGKAHIPKAFLSKEKEETLWHILYSIE
DKQEIEKALHSFANKKNNLSEEFIEQFKNFPPFKKEYGSYSAKAIKKLLPL
MRMGKYWSIENIDNGTRIRINKIIDGEYDENIRERVRQKAINLTDITHFR
ALPLWLACYLVYDRHSEVKDIVKWKTPKDIDLYLKSFKQHSLRNPIVEQV
ITETLRTVDIWQQVGHIDEIHIELGREMKNPADKRARMSQQMIKNENTN
LRIKALLTEFLNPEFGIENVRPYSPSQQDLLRIYEEGVLNSILELPEDIG
IILGKFNQTDTLKRPTRSEILRYKLWLEQKYRSPYTGEMIPLSKLFTPAY
EIEHIIPQSRYFDDSLSNKVICESEINKLKDRSLGYEFIKNHHGEKVELA
FDKPVEVLSVEAYEKLVHESYSHNRSKMKKLLMEDIPDQFIERQLNDSRY
ISKVVKSLLSNIVREENEQEAISKNVIPCTGGITDRLKKDWGINDVWNKI
VLPRFIRLNELTESTRFTSINTNNTMIPSMPLELQKGFNKKRIDHRHHAM
DAIIIACANRNIVNYLNNVSASKNTKITRRDLQTLLCHKDKTDNNGNYKW
VIDKPWETFTQDTLTALQKITVSFKQNLRVINKTTNHYQHYENGKKIVSN
QSKGDSWAIRKSMHKETVHGEVNLRMIKTVSFNEALKKPQAIVEMDLKKK
ILAMLELGYDTKRIKNYFEENKDTWQDINPSKIKVYYFTKETKDRYFAVR
KPIDTSFDKKKIKESITDTGIQQIMLRHLETKDNDPTLAFSPDGIDEMNR
NILILNKGKKHQPIYKVRVYEKAEKFTVGQKGNRKTKFVEAAKGTNLFFA
IYETEEIDKDTKKVIRKRSYSTIPLNVVIERQKQGLSSAPEDENGNLPKY
ILSPNDLVYVPTQEEINKGEVVMPIDRDRIYKMVDSSGITANFIPASTAN
LIFALPKATAEIYCNGENCIQNEYGIGSPQSKNQKAITGEMVKEICFPIK
VDRLGNIIQVGSCILTN

SEQ ID NO: 338
MSRSLTFSFDIGYASIGWAVIASASHDDADPSVCGCGTVLFPKDDCQAFK
RREYYRRLRRNIRSRRVRIERIGRLLVQAQIITPEMKETSGHPAPFYLASE
ALKGHRTLAPIELWHVLRWYAHNRGYDNNASWSNSLSEDGGNGEDRTVH
HAQDLMDKHGTATMAETICRELKLEEGKADAPMEVSTPAYKNLNTAFPRL
IVEKEVRRILELSAPLIPGLTAEIIELIAQHHPLTTEQRGVLLQHGIKLA
RRYRGSLLFGQLIPRFDNRIISRCPVTWAQVYEAELKKGNSEQSARERAE
KLSKVPTANCPEFYEYRMARILCNIRADGEPLSAEIRRELMNQARQEKL
TKASLEKAISSRLGKETETNVSNYFTLHPDSEEALYLNPAVEVLQRSGIG
QILSPSVYRIAANRLRRGKSVTPNYLLNLLKSRGESGEALEKKIEKESKK
KEADYADTPLKPKYATGRAPYARTVLKKVVEEILDGEDPTRPARGEAHPD
GELKAHDGCLYCLLDTDSSVNQHQKERRLDTMTNNHLVRHRMLILDRLLK
DLIQDFADGQKDRISRVCVEVGKELTTFSAMDSKKIQRELTLRQKSHTDA
VNRLKRKLPGKALSANLIRKCRIAMDMNWTCPFFTGATYGDHELENLELEH
IVPHSFRQSNALSSLVLTWPGVNRMKGQRTGYDFVEQEQENPVPDKPNLH
ICSLNNYRELVEKLDDKKGHEDDRRRRKKKRKALLMVRGLSHKHQSQNHEA
MKEIGMTEGMMTQSSHLMKLACKSIKTSLPDAHIDMIPGAVTAEVRKAWD

-continued

VFGVFKELCPEAADPDSGKILKENLRSLTHLHHALDACVLGLIPYIIPAH
HNGLLRRVLAMRRIPEKLIPQVRPVANQRHYVLNDDGRMMLRDLSASLKE
NIREQLMEQRVIQHVPADMGGALLKETMQRVLSVDGSGEDAMVSLSKKKD
GKKEKNQVKASKLVGVFPEGPSKLKALKAAIEIDGNYGVALDPKPVVIRH
IKVFKRIMALKEQNGGKPVRILKKGMLIHLTSSKDPKHAGVWRIESIQDS
KGGVKLDLQRAHCAVPKNKTHECNWREVDLISLLKKYQMKRYPTSYTGTP
R

SEQ ID NO: 339

MTQKVLGLDLGTNSIGSAVRNLDLSDDLQWQLEFFSSDIFRSSVNKESNG
REYSLAAQRSAHRRSRGLNEVRRRRLWATLNLLIKHGFCPMSSESLMRWC
TYDKRKGLFREYPIDDKDFNAWILLDFNGDGRPDYSSPYQLRRELVTRQF
DFEQPIERYKLGRALYHIAQHRGFKSSKGETLSQQETNSKPSSTDEIPDV
AGAMKASEEKLSKGLSTYMKEHNLLTVGAAFAQLEDEGVRVRNNNDYRAI
RSQFQHEIETIFKFQQGLSVESELYERLISEKKNVGTIFYKRPLRSQRGN
VGKCTLERSKPRCAIGHPLFEKFRAWTLINNIKVRMSVDTLDEQLPMKLR
LDLYNECFLAFVRTEFKFEDIRKYLEKRLGIHFSYNDKTINYKDSTSVAG
CPITARFRKMLGEEWESFRVEGQKERQAHSKNNISFHRVSYSIEDIWHFC
YDAEEPEAVLAFAQETLRLERKKAEELVRIWSAMPQGYAMLSQKAIRNIN
KILMLGLKYSDAVILAKVPELVDVSDEELLSIAKDYYLVEAQVNYDKRIN
SIVNGLIAKYKSVSEEYRFADHNYEYLLDESDEKDIIRQIENSLGARRWS
LMDANEQTDILQKVRDRYQDFFRSHERKFVESPKLGDRSFENYLTKKFPMV
EREQWKKLYHPSQITIYRPVSVGKDRSVRLRLGNPDIGAIKNPTVLRVLNT
LRRRVNQLLDDGVISPDETRVVVETARELNDANRKWALDTYNRIRHDENE
KIKKILEEFYPKRDGISTDDIDKARYVIDQREVDYFTGSKTYNKDIKKYK
FWLEQGGQCMYTGRTINLSNLFDPNAFDIEHTIPESLSFDSSDMNLTLCD
AHYNRFIKKNHIPTDMPNYDKAITIDGKEYPAITSQLQRWVERVERLNRN
VEYWKGQARRAQNKDRKDQCMREMHLWKMELEYWKKKLERFTVTEVTDGF
KNSQLVDTRVITRHAVLYLKSIFPHVDVQRGDVTAKFRKILGIQXSVDEKK
DRSLHSHHAIDATTLTIIPVSAKRDRMLELFAKIEEINKMLSFSGSEDRT
GLIQELEGLKNKLQMEVKVCRIGHNVSEIGTFINDNIIVNHHIKNQALTP
VRRRLRKKGYIVGGVDNPRWQTGDALRGEIHKASYYGAITQPAKDDEGKV
LMKEGRPQVNPTIKFVIRRELKYKKSAADSGFASWDDLGKAIVDKELFAL
MKGQFPAETSFKDACEQGIYMIKKGKNGMPDIKLHHIRHVRCEAPQSGLK
IKEQTYKSEKEYKRYFYAAVGDLYAMCCYTNGKIREFRIYSLYDVSCHRK
SDIEDIPEFITDKKGNRLMLDYKLRTGDMILLYKDNPAELYDLDNVNLSR
RLYKINRFESQSNLVLMTHHLSTSKERGRSLGKTVDYQNLPESIRSSVKS
LNFLIMGENRDFVIKNGKIIFNHR

SEQ ID NO: 340

MLVSPISVDLGGKNTGFFSFTDSLDNSQSGTVIYDESFVLSQVGRRSKRH
SKRNNLRNKLVKRLFLLILQEHHGLSIDVLPDEIRGLFNKRGYTYAGFEL
DEKKKDALESDTLKEFLSEKLQSIDRDSDVEDFLNQIASNAESFKDYKKG
FEAVFASATHSPNKKLELKDELKSEYGENAKELLAGLRVTKEILDEFDKQ
ENOGNLPRAKYFEELGEYIATNEKVKSFFDSNSLKLTDMTKLIGNISNYQ
LKELRRYFNDKEMEKGDIWIPNKLHKITERFVRSWHPKNDADRQRRAELM
KDLKSKEIMELLTTTEPVMTIPPYDDMMNRGVANLKFVFEEEYLDKHLP
NWRDIAKRLNHGKFNDDLADSTVKGYSEDSTLLHRLLDTSKEIDIYELRG
KKPNELLVKTLGQSDANRLYGFAQNYYELIRQKVRAGIWVPVKNKDDSLN
LEDNSNMLKRCNHNPPHKKNQIHNLVAGILGVKLDEAKFAEFEKELWSAK
VGNKKLSAYCKNIEELRKTHGNTFKIDIEELRKKDPAELSKEKAKLRLT
DDVILNEWSQKIANFFDIDDKHRQRFNNLFSMAQLHTVIDTPRSGFSSTC
KRCTAENRFRSETAFYNDETGEFHKKATATCQRLPADTQRPFSGKIERYI
DKLGYELAKIKAKELEGMEAKEIKVPIILEQNAFEYEESLRKSKTGSNDR
VINSKKDRDGKKLAKAKENAEDRLKDKDKRIKAFSSGICPYCGDTIGDDG
EIDHILPRSHTLKIYGTVFNPEGNLIYVHQKCNQAKADSIYKLSDIKAGV
SAQWIEEQVANIKGYKTFSVLSAEQQKAFRYALFLQNDNEAYKKVVDWLR
TDQSARVNGTQKYLAKKIQEKLTKMLPNKHLSFEFILADATEVSELRRQY
ARQNPLLAKAEKQAPSSHAIDAVMAFVARYQKVRFDKFDRLKLPDADEVAKLEM
LDSWNPASNEPLTKGLSTNQKIEKMIKSGDYGQKNMREVFGKSIFGENAI
GERYKPIVVQEGGYYIGYPATVKKGYELKNCKVVTSKNDIAKLEKIIKNQ
DLISLKENQYIKIFSINKQTISELSNRYFNMNYKNLVERDKEIVGLLEFI
VENCRYYTKKVDVKFAPKYIHETKYPFYDDWRRFDEAWRYLQENQNKTSS
KDRFVIDKSSLNEYYQPDKNYKLDVDTQPIWDDFCRWYFLDRYKTANDK
KSIRIKARKTFSLLAESGVQGKVFRAKRKIPTGYAYQALPMDNNVIAGDY
ANILLEANSKTLSLVPKSGISIEKQLDKKLDVIKKTDVRGLAIDNNSFFN
ADFDTHGIRLIVENTSVKVGNFPISAIDKSAKRMIFRALFEKEKGKRKKK
TTISFKESGPVQDYLVFLKKIVKIQLRTDGSISNIVVRKNAADFTLSFR
SEHIQKLLK

SEQ ID NO: 341

MAYRLGLDIGITSVGWAVVALEKDESGLKPVRIQDLGVRIFDKAEDSKTG
ASLALPRREARSARRRTRRRRHRLWRVKRLLEQHGILSMEQIEALYAQRT
SSPDVYALRVAGLDRCLIAEEIARVLIHIAHRRGFQSNRKSEIKDSDAGK
LLKAVQENENLMQSKGYRTVAEMLVSEATKTDAEGKLVHGKKHGYVSNVR
NKAGEYRHTVSRQAIVDEVRKIFAAQRALGNDVMSELEDSYLKILCSQEN
NFDDGPGGDSPYGHGSVSPDGVRQSIYERMVGSCTFETGEKRAPRSSYSF
ERFQLLTKVVNLRIYRQQEDGGRYPCELTQTERARVIDCAYEQTKITYGK
LRKLLLDMKDTESFAGLTYGLNRSRNKTEDTVFVEMKFYHEVRKALQRAGV
FIQDLSIETLDQIGWILSVWKSDDNRRKKLSTLGLSDNVIEELLPLNGSK
FGHLSLKAIRKILPFLEDGYSYDVACELAGYQFQGKTEYVKQRLLPPLGE

-continued

GEVTNPVVRRALSQAIKVVNAVIRKHGSPESIHIELARELSKNLDERRKI
EKAQKENQKNNEQIKDEIREILGSAHVTGRDIVKYKLFKQQQEFCMYSGE
KLDVTRLFEPGYAEVDHIIPYGISFDDSYDNKVLVKTEQNRQKGNRTPLE
YLRDKPEQKAKFIALVESIPLSQKKKNHLLMDKRAIDLEQEGFRERNLSD
TRYIITRALMNHIQAWLLFDETASTRSKRVVCVNGAVTAYMRARWGLTKDR
DAGDKHHAADAVVVACIGDSLIQRVTKYDKFKRNALADRNRYVQQVSKSE
GITQYVDKETGEVFTWESFDERKFLPNEPLEPWPFFRDELLARLSDDPSK
NIRAIGLLTYSETEQIDPIFVSRMPTRKVTGAAHKETIRSPRIVKVDDNK
GTEIQVVSKVALTELKLTKDGEIKDYFRPEDDPRLYNTLRERLVQFGGD
AKAAFKEPVYKISKDGSVRTPVRKVKIQEKLTLGVPVHGGRGIAENGGMV
RIDVFAKGGKYYFVPIYVADVLKRELPNRLATAHKPYSEWRVVDDSYQFK
FSLYPNDAVMIKPSREVDITYKDRKEPVGCRIMYFVSANIASASISLRTH
DNSGELEGLGIQGLEVFEKYVVGPLGDTHPVYKERRMPFRVERKMN

SEQ ID NO: 342

MPVLSPLSPNAAQGRRRWSLALDIGEGSIGWAVAEVDAEGRVLQLTGTGV
TLFPSAWSNENGTYVAHGAADRAVRGQQQRHDSRRRRLAGLARLCAPVLE
RSPEDLKDLTRTPPKADPRAIFFLRADAARRPLDGPELFRVLHHMAAHRG
IRLAELQEVDPPPESDADDAAPAATEDEDGTRRAAADERAFRRLMAEHMH
RHGTQPTCGEIMAGRLRETPAGAQPVTRARDGLRVGGGVAVPTRALIEQE
FDAIRAIQAPRHPDLPWDSLRRLVLDQAPIAVPPATPCLFLEELRRRGET
FQGRTITREAIDRGLTVDPLIQALRIRETVGNLRLHERITEPDGRQRYVP
RAMPELGLSHGELTAPERDTLVRALMHDPDGLAAKDGRIPYTRLRKLIGY
DNSPVCFAQERDTSGGGITVNPTDPLMARWIDGWVDLPLKARSLYVRDVV
ARGADSAALARLLAEGAHGVPPVAAAAVPAATAAILESDIMQPGRYSVCP
WAAEAILDAWANAPTEGPLVTRGLFGFAPGEIVLEDLRRARGALLAHLP
RTMAAARTPNRAAQQRGPLPAYESVIPSQLITSLRRAHKGRAADWSAADP
EERNPFLRTWTGNAATDHILNQVRKTANEVITKYGNRRGWDPLPSRITVE
LAREAKHGVIRRNEIAKENRENEGRRKKESAALDTFCQDNTVSWQAGGLP
KERAALRLRLAQRQEFFCPYCAERPKLRATDLFSPAETEIDHVIERRMGG
DGPDNLVLAHKDCNNAKGKKTPHEHAGDLLDSPALAALWQGWRKENADRL
KGKGHKARTPREDKDFMDRVGWRFEEDARAKAEENQERRGRRMLHDTARA
TRLARLYLAAAVMPEDPAEIGAPPVETPPSPEDPTGYTAIYRTISRVQPV
NGSVTHMLRQRLLQRDKNRDYQTHHAEDACLLLLAGPAVVQAFNTEAAQH
GADAPDDRPVDLMPTSDAYHQQRRARALGRVPLATVDAALADIVMPESDR
QDPETGRVHWRLTRAGRGLKRRIDDLTRNCVILSRPRRPSETGTPGALHN
ATHYGRREITVDGRTDTVVTQRMNARDLVALLDNAKIVPAARLDAAAPGD
TILKEICTEIADRHDRVVDPEGTHARRWISARLAALVPAHAEAVARDIAE
LADLDALADADRTPEQEARRSALRQSPYLGRAISAKKADGRARAREQEIL
TRALLDPHWGPRGLRHLIMREARAPSLVRIRANKTDAFGRPVPDAAVVVK
TDGNAVSQLWRLTSVVTDDGRRIPLPKPIEKRIEISNLEYARLNGLDEGA
GVTGNNAPPRPLRQDIDRLTPLWRDHGTAPGGYLGTAVGELEDKARSALR
GKAMRQTLTDAGITAEAGWRLDSEGAVCDLEVAKGDTVKKDGKTYKVGVI
TQGIFGMPVDAAGSAPRTPEDCEKFEEQYGIKPWKAKGIPLA

SEQ ID NO: 343

MNYTEKEKLFMKYILALDIGIASVGWAILDKESETVIEAGSNIFPEASAA
DNQLRRDMRGAKRNNRRLKTRINDFIKLWENNNLSIPQFKSTEIVGLKVR
AITEEITLDELYLILYSYLKHRGISYLEDALDDTVSGSSAYANGLKLNAK
ELETHYPCEIQQERLNTIGKYRGQSQIINENGEVLDLSNVFTIGAYRKEI
QRVFEIQKVHPELTDEFCDGYMLIHRKRKYYEGPGNEKSRTDYGRFTT
KLDANGNYITEDNIFEKLIGKCSVYPDELRAAAASYTAQEYNVLNDLNNL
TINGRKLEENEKHEIVERIKSSNTINMRKIISDCMGENIDDFAGARIDKS
GKEIFHKFEVYNKMRKALLEIGIDISNYSREELDEIGYIMTINTDKEAMM
EAFQKSWIDLSDVKQCLINMRKTNGALFNKWQSFSLKIMNELIPEMYAQ
PKEQMTLLTEMGVTKGTQEEFAGLKYIPVDVVSEDIFNPVVRRSVRISFK
ILNAVLKKYKALDTIVIEMPRDRNSEEQKKRINDSQKLNEKEMEYIEKKL
AVTYGIKLSPSDFSSQKQLSLKLKLWNEQDGICLYSGKTIDPNDIINNPQ
LFEIDHIIPRSISFDDARSNKVLVYRSVENQKKGKGNQTPYYYLTHSHSEWSF
EQYKATVMNLSKKKEYAISRKKIQNLLYSEDITKMDVLKGFINRNINDTS
YASRLVLNTIQNFFMANEADTKVKVIKGSYTHQMRCNLKLDKNRDESYSH
HAVDAMLIGYSELGYEAYHKLQGEFIDFETGEILRKDMWDENMSDEVYAD
YLYGKKWANIRNEVVKAEKNVKYWHYVMRKSNRGLCNQTIRGTREYDGKQ
YKINKLIRTKEGIKVFAKLAFSKKDSDRERLLVYLNDRRTFDDLCKIYE
DYSDAANPFVQYEKETGDIIRKYSKKHNGPRIDKLKYKDGEVGACIDISH
KYGFEKGSKKVILESLVPYRMDVYKEENHSYYLVGVKQSDIKFEKGRNV
IDEEAYARILVNEKMIQPGQSRADLENLGFKFKLSFYKNDIIEYEKDGKI
YTERLVSRTMPKQRNYIETKPIDKAKFEKQNLVGLGKTKFIKKYRYDILG
NKYSCSEEKFTSFC

SEQ ID NO: 344

MLRLYCANNLVLNNVQNLWKYLLLLIFDKKIIFLFKIKVILIRRYMENNN
KEKIVIGFDLGVASVGWSIVNAETKEVIDLGVRLFSEPEKADYRRAKRTT
RRLLRRKKFKREKPHKLILKNAEIFGLQSRNEILNVYKDQSSKYRNILKL
KINALKEEIKPSELVWILRDYLQNRGYFYKNEKLTDEFVSNSFPSKKLHE
HYEKYGFFRGSVKLDNLDNKKDKAKEKDEEEESDAKKESEELIFSNKQW
INEIVKVFENQSYLTESFKEEYLKLFNYVRPPFNKGPGSKNSRTAYGVFST
DIDPETNKFKDYSNIWDKTIGKCSLFEEEIRAPKNLPSALIFNLQNEICT
IKNEFTEFKNWWLNAEQKSEILKFVFTELFNWKDKKYSDKKFNKNLQDKI
KKYLLNFALENFNLNEEILKNRDLENDTVLGLKGVKYYEKSNATADAALE
FSSLKPLYVFIKFLKEKKLDLNYLLGLENTEILYFLDSIYLAISYSSDLK

-continued

ERNEWFKKLLKELYPKIKNNNLEIIENVEDIFEITDQEKFESFSKTHSLS
REAFNHIIPLLLSNNEGKNYESLKHSNEELKKRTEKAELKAQQNQKYLKD
NFLKEALVPLSVKTSVLQAIKIFNQIIKNFGKKYEISQVVIEMARELTKP
NLEKLLNNATNSNIKILKEKLDQTEKFDDFTKKKFIDKIENSVVFRNKLF
LWFEQDRKDPYTQLDIKINEIEDTELDHVIPYSKSADDSWFNKLLVKKS
TNQLKKNKTVWEYYQNESDPEAKWNKFVAWAKRIYLVQKSDKESKDNSEK
NSIFKNKKPNLKFKNITKKLFDPYKDLGFLARNLNDTRYATKVFRDQLNN
YSKHHSKDDENKLFKVVCMNGSITSFLRKSMWRKNEEQVYRFNFWKKDRD
QFFHHAVDASIIAIFSLLTKTLYNKLRVYESYDVQRREDGVYLINKETGE
VKKADKDYWKDQHNFLKIRENAIEIKNVLNNVDFQNQVRYSRKANTKLNT
QLFNETLYGVKEFENNYKLEKVNLFSRKDLRKFILEDLNEESEKNKKNE
NGSRKRILTEKYIVDEILQILENEEFKDSKSDINALNKYMDSLPSKFSEF
FSQDFINKCKKENSLILTFDAIKHNDPKKVIKIKNLKFFREDATLKNKQA
VHKDSKNQIKSFYESYKCVGFIWLKNKNDLEESIFVPINSRVIHFGDKDK
DIFDFDSYNKEKLLNEINLKRPENKKFNSINEIEFVKFVKPGALLLNFEN
QQIYYISTLESSSLRAKIKLLNKMDKGAVSMKKITNPDEYKIIEHVNPL
GINLNWTKKLENNN

SEQ ID NO: 345
MLMSKHVLGLDLGVGSIGWCLIALDAQGDPAEILGMGSRVVPLNNATKAI
EAFNAGAAFTASQERTARRTMRRGFARYQLRRYRLRRELEKVGMLPDAAL
IQLPLLELWELRERAATAGRRLTLPELGRVLCINLNNLTYPTETKKLSKA
VGDEGEKKKDSNSAYLAGIRANDEKLQAEHKTVGQYFAEQLRQNQSESPT
GGISYRIKDQIFSRQCYIDEYDQIMAVQRVHYPDILTDEFIRMLRDEVIF
MQRPLKSCKHLVSLCEFEKQERVMRVQQDDGKGGWQLVERRVKFGPKVAP
KSSPLFQLCCIYEAVNNIRLTRPNGSPCDITPEERAKIVAHLQSSASLSF
AALKKLLKEKALIADQLTSKSGLKGNSTRVALASALQPYPQYHHLLDMEL
ETRMMTVQLTDEETGEVTEREVAVVTDSYVRKPLYRLWHILYSIEEREAM
RRALITQLGMKEEDLDGGLLDQLYRLDFVKPGYGNKSAKFICKLLPQLQQ
GLGYSEACAAVGYRHSNSPTSEEITERTLLEKIPLLQPNELRQPLVEKIL
NQMINLVNALKAEYGIDEVRVELARELKMSREERERMARNNKDREERNKG
VAAKIRECGLYPTKPRIQKYMLWKEAGRQCLYCGRSIEEEQCLREGGMEV
EHIIPKSVLYDDSYGNKTCACRRCNKEKGNRTALEYIRAKGREAEYMKRI
NDLLKEKKISYSKHQRLRWLKEDIPSDFLERQPLRLTQYISRQAMAILQQG
IRRVSASEGGVTARLSLWGYGKILHTLNLDRYDSMGETERVSREGEATE
ELHITNWSKRMDHRHHAIDALVVACTRQSYIQRLNRLSSEFGREDKKKED
QEAQEQQATETGRLSNLERWLTQRPHFSVRTVSDKVAEILISYRPGQRVV
TRGRNIYRKKMADGREVSCVQRGVLVPRGELMEASFYGKILSQGRVRIVK
RYPLHDLKGEVVDPHLRELITTYNQELKSREKGAPIPPPLCLDKDKKQEVR
SVRCYAKTLSLDKAIPMCFDEKGEPTAFVKSASNHHLALYRTPKGKLVES
IVTFWDAVDRARYGIPLVITHPREVMEQVLQRGDIPEQVLSLLPPSDWVF
VDSLQQDEMVVIGLSDEELQRALEAQNYRKISEHLYRVQKMSSSYYVFRY
HLETSVADDKNTSGRIPKFHRVQSLKAYEERNIRKVRVDLLGRISLL

SEQ ID NO: 346
MSDLVLGLDIGIGSVGVGILNKVTGEIIHKNSRIFPAAQAENNLVRRTNR
QGRRLARRKKHRRVRLNRLFEESGLITDFTKISINLNPYQLRVKGLTDEL
SNEELFIALKNMVKHRGISYLDDASDDGNSSVGDYAQIVKENSKQLETKT
PGQIQLERYQTYGQLRGDFTVEKDGKKHRLINVFPTSAYRSEALRILQTQ
QEFNPQITDEFINRYLEILTGKRKYYHGPGNEKSRTDYGRYRTSGETLDN
IFGILIGKCTFYPDEFRAAKASYTAQEFNLLNLTYPTETKTTETKKLSKQ
KNQIINYVKNEKAMGPAKLFKYIAKLLSCDVADIKGYRIDKSGKAEIHTF
EAYRKMKTLETLDIEQMDRETLDKLAYVLTLNTEREGIQEALEHEFADGS
FSQKQVDELVQFRKANSSIFGKGWHNFSVKLMMELIPELYETSEEQMTIL
TRLGKQKTTSSSNKTKYIDEKLLTEEIYNPVVAKSVRQAIKIVNAAIKEY
GDFDNIVIEMARETNEDDEKKAIQKIQKANKDEKDAAMLKAANQYNGKAE
LPHSVFHGHKQLATKIRLWHQQGERCLYTGKTISIHDLINNSNQFEVDHI
LPLSITFDDSLANKVLVYATANQEKGQRTPYQALDSMDDAWSFRELKAFV
RESKTLSNKKKEYLLTEEDISKFDVRKKFIERNLVDTRYRKLLVVNALQE
HFRAHKIDTKVSVVRGQFTSQLRRHWGIEKTRDTYHHHAVDALIIAASSQ
LNLWKKQKNTLVSYSEDQLLDIETGELISDDEYKESVFKAPYQHFVDTLK
SKEFEDSILFSYQVDSKFNRKISDATIYATRQAKVGKDKADETYVLGKIK
DIYTQDGYDAFMKIYKKDKSKFLMYRHDPQTFEKVIEPILENYPNKQINE
KGKEVPCNPFLKYKEEHGYIRKYSKKGNGPEIKSLKYYDSKLGNHIDITP
KDSNNKVVLQSVSPWRADVYFNKTTGKYEILGLKYADLQFEKGTGTYKIS
QEKYNDIKKKEGVDSDSEFKFTLYKNDLLLVKDTETKEQQLFRFLSRTMP
KQKHYVELKPYDKQKFEGGEALIKVLGNVANSGQCKKGLGKSNISIYKVR
TDVLGNQHIIKNEGDKPKLDF

SEQ ID NO: 347
MNAEHGKEGLLIMEENFQYRIGLDIGITSVGWAVLQNNSQDEPVRITDLG
VRIFDVAENPKNGDALAAPRRDARTTRRRLRRRRHRLERIKFLLQENGLI
EMDSFMERYYKGNLPDVYQLRYEGLDRKLKDEELAQVLIHIAKHRGFRST
RKAETKEKEGGAVLKATTENQKIMQEKGYRTVGEMLYLDEAFHTECLWNE
KGYVLTPRNRPDDYKHTILRSMLVEEVHAIFAAQRAHGNQKATEGLEEAY
VEIMTSQRSFDMGPGLQPDGKPSPYAMEGFGDRVGKCTFEKDEYRAPKAT
YTAELFVALQKINHTKLIDEFGTGRFFSEEERKTIIGLLLSSKELKYGTI
RKKLNIDPSLKFNSLNYSAKKEGTEEERVLDTEKAFSMFWTYEYSKC
LKDRTEEMPVGEKADLFDRIGEILTAYKNDDSRSSRLKELGLSGEEIDGL
LDLSPAKYQRVSLKAMRKMQPYLEDGLIYDKACEAAGYDFRALNDGNKKH
LLKGEEINAIVNDITNPVVKRSVSQTIKIVNAIIQKYGSPQAVNIELARE

SEQ ID NO: 348
MRVLGLDAGIASLGWALIEIEESNRGELSQGTIIGAGTWMFDAPEEKTQA
GAKLKSEQRRTFRGQRRVVRRRRQRMNEVRRILHSHGLLPSSDRDALKQP
GLDPWRIRAEALDRLLGPVELAVALGHIARHRGFKSNSKGAKTNDPADDT
SKMKRAVNETREKLARFGSAAKMLVEDESFVLRQTPTKNGASEIVRRFRN
REGDYSRSLLRDDLAAEMRALFTAQARFQSAIATADLQTAFTKAAFFQRP
LQDSEKLVGPCPFEVDEKRAPKRGYSFELFRFLSRLNHVTLRDGKQERTL
TRDELALAAADFGAAAKVSFTALRKLKLPETTVFVGVKADEESKLDVRA
RSGKAAEGTARLRSVIVDALGELAWGALLCSPEKLDKIAEVISFRSDIGR
ISEGLAQAGCNAPLVDALTAAASDGRFDPFTGAGHISSKAARNILSGLRQ
GMTYDKACCAADYDHTASRERGAFDVGGHGREALKRILQEERISRELVGS
PTARKALIESIKQVKAIVERYGVPDRIHVELARDVGKSIEEREEITRGIE
KRNRQKDKLRGLFEKEVGRPPQDGARGKEELLRFELWSEQMGRCLYTDDY
ISPSQLVATDDDAVQVDHILPWSRFADDSYANKTLCMAKANQDKKGRTPYE
WFKAEKTDTEWDAFIVRVEALADMKGFKKRNYKLRNAEEEAAAKFRNRNLN
DTRWACRLLAEALKLQKYPKGEKDKDGKERRRVFSRPGALTDRLRRAWGLQ
WMKKSTKGDRIPDDRHHALDAIVIAATTESLLQRATREVQEIEDKGLHYD
LVKNVTPPWPGFREQAVEAVEKVFVARAERRRARGKAHDATIRHIAVREG
EQRVYERRKVAELKLADLDRVKDAERNARLIEKLRNWIEAGSPKDDPPLS
PKGDPIFKVRLVTKSKVNIALDTGNPKRPGTVDRGEMARVDVFRKASKKG
KYEYYLVPIYPHDIATMKTPPIRAVQAYKPEDEWPEMDSSYEFCWSLVPM
TYLQVISSKGEIFEGYYRGMNRSVGAIQLSAHSNSSDVVQGIGARTLTEF
KKFNVDRFGRKHEVERELRTWRGETWRGKAYI

SEQ ID NO: 349
MGNYYLGLDVGIGSIGWAVINIEKKRIEDFNVRIPFKSGEIQEKNRNSRAS
QQCRRSRGLRRLYRRKSHRKLRLKNYLSIIGLTTSEKIDYYYETADNNVI
QLRNKGLSEKLTPEEIAACLIHICNNRGYKDFYEVNVEDIEDPDERNEYK
EEHDSIVLISNLMNEGGYCTPAEMICNCREFDEPNSVYRKFHNSAASKNH
YLITRHMLVKEVDLILENQSKYYGILDDKTIAKIKDIIFAQRDFEIGPGK
NERFRRFTGYLDSIGKCQFFKDQERGSRFTVIADIYAFVNVLSQYTYTNN
RGESVFDTSFANDLINSALKNGSMDKRELKAIAKSYHIDISDKNSDTSLT
KCFKYIKVVKPLFEKYGYDWDKLIENYTDTDNNVLNRIGIVLSQAQTPKR
RREKLKALNIGLDDGLINELTKLKLSGTANVSYKYMQGSIEAFCEGDLYG
KYQAKFNKEIPDIDENAKPQKLPPPKNEDDCEFFKNPVVFRSINETRKLI
NAIIDKYGYPAAVNIETADELNKTFEDRAIDTKRNNDNQKENDRIVKEII
ECIKECDVHARHLIEKYKLWEAQEGKCLYSGETITKEDMLRDKDKLFEVD
HIVPYSLILDNTINNKALVYAEENQKKGQRTPLMYMNEAQAADYRVRVNT
MFKSKKCSKKKYQYLMLPDLNDQELLGGWRSRNLNDTRYICKYLVNYLRK
NLRFDRSYESSDEDDLKIRDHYRVFPVKSRFTSMFRRWWLNEKTWGRYDK
AELKKLTYLDHAADAIIIANCRPEYVVLAGEKLKLNKMYHQAGKRITPEY
EQSKKACIDNLYKLFRMDRRTAEKLLSGHGRLTPIIPNLSEEVDKRLWDK
NIYEQFWKDDKDKKSCEELYRENVASLYKGDPKFASSLSMPVISLKPDHK
YRGTITGEEAIRVKEIDGKLIKLRKSISEITAESINSIYTDDKILIDSL
KTIFEQADYKDVGDYLKKTNQHFFTTSSGKRVNKVTVIEKVPSRWLRKEI
DDNNFSLLNDSSYYCIELYKDSKGDNNLQGIAMSDIVHDRKTKKLYLKPD
FNYPDDYYTHVMYIFPGDYLRIKSTSKKSGEQLKFEGYFISVKNVNENSF
RFISDNKPCAKDKRVSITKKDIVIKLAVDLMGKVQGENNGKGISCGEPLS
LLKEKN

SEQ ID NO: 350
MLSRQLLGASHLARPVSYSYNVQDNDVHCSYGERCFMRGKRYRIGIDVGL
NSVGLAAVEVSDENSPVRLLNAQSVIHDGGVDPQKNKEAITRKNMSGVAR
RTRRMRRRKRERLHKLDMLLGKFGPVIPESLDKPFEEWHVRAELATRY
IEDDELRRESISIALRHMARHRGWRNPYRQVDSLISDNPYSKQYGELKEK
AKAYNDDATAAEEESTPAQLVVAMLDAGYAEAPRLRWRTGSKKPDAEGYL
PVRLMQEDNANELKQIFRVQRVPADEWKPLFRSVFYAVSPKGSAEQRVGQ
DPLAPEQARALKASLAFQGEYPLANVITNLRIKDASAELRKLTVDEKQSIY
DQLVSPSSEDITWSDLCDFLGFKRSQLKGVGSLTEDGEERISSRPPRLTS
VQRIYESDNKIRKPLVAWWKSASDNEHEAMIRLLSNTVDIDKVREDVAYA
SAIEFIDGLDDDALTKLDSVDLPSGRAAYSVETLQKLTRQMLTTDDDLHE
ARKTLFNVTDSWRPPADPIGEPLGNPSVRLKVNLYLMNCQQRWGNPV
SVNIEHVRSSFSSVAFARKDKREYEKNNEKRSIFRSSLSEQLRADEQMEK
VRESDLRRLEAIQRQNGQCLYCGRTITFRCTCEMDHIVPRKGVGSTNTRTN
FAAVCAECNRMKSNTPFAIWARSEDAQTRGVSLAEAKKRVTMFTFNPKSY
APREVKAFKQAVIARLQQTEDDAAIDNRSIESVAWMADELHRRIDWYFNA
KQYVNSASIDDAEAETMKTTVSVFQGRVTASARRAAGIEGKIHFIGQQSK

-continued

TRLDRRHHAVDASVIAMMNTAAAQTLMERESLRESQRLIGLMPGERSWKE
YPYEGTSRYESFHLWLDNMDVLLELLNDALDNDRIAVMQSQRYVLGNSIA
HDATIHPLEKVPLGSAMSADLIRRASTPALWCALTRLPDYDEKEGLPEDS
HREIRVHDTRYSADDEMGFFASQAAQIAVQEGSADIGSAIHHARVYRCWK
TNAKGVRKYFYGMIRVPQTDLLRACHDDLFTVPLPPQSISMRYGEPRVVQ
ALQSGNAQYLGSLVVGDEIEMDFSSLDVDGQIGEYLQFFSQFSGGNLAWK
HWVVDGFFNQTQLRIRPRYLAAEGLAKAFSDDVVPDGVQKIVTKQGWLPP
VNTASKTAVRIVRRNAFGEPRLSSAHHMPCSWQWRHE

SEQ ID NO: 351

MYSIGLDLGISSVGWSVIDERTGNVIDLGVRLFSAKNSEKNLERRTNRGG
RRLIRRKTNRLKDAKKILAAVGFYEDKSLKNSCPYQLRVKGLTEPLSRGE
IYKVTLHILKKRGISYLDEVDTEAAKESQDYKEQVRKNAQLLTKYTPGQI
QLQRLKENNRVKTGINAQGNYQLNVFKVSAYANELATILKTQQAFYPNEL
TDDWIALFVQPGIAEEAGLIYRKRPYYHGPGNEANNSPYGRWSDFQKTGE
PATNIFDKLIGKDFQGELRASGLSLSAQQYNLLNDLTNLKIDGEVPLSSE
QKEYILTELMTKEFTRFGVNDVVKLLGVKKERLSGWRLDKKGKPEIHTLK
GYRNWRKIFAEAGIDLATLPTETIDCLAKVLTLNTEREGIENTLAFELPE
LSESVKLLVLDRYKELSQSISTQSWHRFSLKTLHLLIPELMNATSEQNTL
LEQFQLKSDVRKRYSEYKKLPTKDVLAEIYNPTVNKTVSQAFKVIDALLV
KYGKEQIRYITIEMPRDDNEEDKKRIKELHAKNSQRKNDSQSYFMQKSG
WSQEKFQTTIQKNRRFLAKLLYYYEQDGICAYTGLPIPSPELLVSDSTEID
HIIPISISLDDSINNKVLVLSKANQVKGQQTPYDAWMDGSFKKINGKFSN
WDDYQKWVESRHFSHKKENNLLETRNIFDSEQVEKFLARNLNDTRYASRL
VLNTLQSFFTNQETKVRVVNGSFTHTLRKKWGADLDKTRETHHHHAVDAT
LCAVTSFVKVSRYHYAVKEETGEKVMREIDFETGEIVNEMSYWEFKKSKK
YERKTYQVKWPNFREQLKPVNLHPRIKFSHQVDRKANRKLSDATIYSVRE
KTEVKTLKSGKQKITTDEYTIGIKIDIYTLDGWEAFKKKQDKLLMKDLDE
KTYERLLSIAETTPDFQEVEEKNGKVKRVKRSPFAVYCEENDIPAIQKYA
KKNNGPLIRSLKYYDGKLNKHINITKDSQGRPVEKTKNGRKVTLQSLKPY
RYDIYQDLETKAYYTVQLYYSDLRFVEGKYGITEKEYMKKVAEQTKGQVV
RPCFSLQKNDGLEIEWKDSQRYDVRFYNFQSANSINFKGLEQEMMPAENQ
FKQKPYNNGAINLNIAKYGKEGKKLRKFNTDILGKKHYLFYEKEPKNIIK

SEQ ID NO: 352

MYFYKNKENKLNKKVVLGLDLGIASVGWCLTDISQKEDNKFPIILHGVRL
FETVDDSDDKLLNETRRKKRGQRRRNRRLFTRKRDFIKYLIDNNIIELEF
DKNPKILVRNFIEKYINPFSKNLELKYKSVTNLPIGFHNLRKAAINEKYK
LDKSELIVLLYFYLSLRGAFFDNPEDTKSKEMNKNEIEIFDRKNESIKNAE
FPIDKIIEFYKISGKIRSTINLKFGHQDYLKEIKQVFEKQNIDFMNYEKF
AMEEKSFFSRIRNYSEGPGNEKSFSKYGLYANENGNPELIINEKGQKIYT
KIFKTLWESKIGKCSYDKKLYRAPKNSFSAKVFDITNKLTDWKHKNEYIS
ERLKRKILLSRFLNKDSKSAVEKILKEENIKFENLSEIAYNKDDNKINLP
IINAYHSLTTIFKKHLINFENYLISNENDLSKLMSFYKQQSEKLFVPNEK
GSYEINQNNNVLHIFDAISNILNKFSTIQDRIRILEGYFEFSNLKKDVKS
SEIYSEIAKLREFSGTSSLSFGAYYKFIPNLISEGSKNYSTISYEEKALQ
NQKNNFSHSNLFEKTWVEDLIASPTVRKSLRQTMNLLKEIKYSENNQLTE
IEKIVVEVTRSSNNKHERKKIEGINKYRKEKYEELKKVYDLPNENTTLLK
KLWLLRQQQGYDAYSLRKIEANDVINKPWNYDIDHIVPRSISFDDSFSNL
VIVNKLDNAKKSNDLSAKQFIEKIYGIEKLKEAKENWGNWYLRNANGKAF
NDKGKFIKLYTIDNLDEFDNSDFINRNLSDTSYITNALVNHLTFSNSKYK
YSVVSVNGKQTSNLRNQIAFVGIKNNKETEREWKRPEGFKSINSNDFLIR
EEGKNDVKDDVLIKDRSFNGHHAEDAYFITIISQYFRSFKRIERLNVNYR
KETRELDDLEKNNIFKFEKASFDNFLLINALDELNEKLNQMRFSRMVITK
KNTQLFNETLYSGKYDKGKNTIKKVEKLNLLDNRTDKIKIKIEEFFDEDKL
KENELTKLHIFNHDKNLYETLKIIWNEVKIEIKNKNLNEKNYFKYFVNKK
LQEGKISFNEWVPILDNDFKIIRKIRYIKFSSEEKETDEIIFSQSNFLKI
DQRQNFSFHNTLYWVQIWVYKNQKDQYCFISIDARNSKFEKDEIKINYEK
LKTQKEKLQIINEEPILKINKGDLFENEEKELFYIVGRDEKPQKLEIKYI
LGKKIKDQKQIQKPVKKYFPNWKKVNLTYMGEIFKK

SEQ ID NO: 353

MDNKNYRIGIDVGLNSIGFCAVEVDQHDTPLGFLNLSVYRHDAGIDPNGK
KTNTTRLAMSGVARRTRRLFRKRKRRLAALDRFIEAQGWTLPDHADYKDP
YTPWLVRAELAQTPIRDENDLHEKLAIAVRHIARHRGWRSPWVPVRSLHV
EQPPSDQYLALKERVEAKTLLQMPEGATPAEMVVALDLSVDVNLRPKNRE
KTDTRPENKKPGFLGGKLMQSDNANELRKIAKIQGLDDALLRELIELVFA
ADSPKGASGELVGYDVLPGQHGKRAEKAHPAFQRYRIASIVSNLRIRHL
GSGADERLDVETQKRVFEYLLNAKPTADITWSDVAEEIGVERNLLMGTAT
QTADGERASAKPPVDVTNVAFATCKIKPLKEWWLNADYEARCVMVSALSH
AEKLTEGTAAEVEVAEFLQNLSDEDNEKLDSFSLPIGRAAYSVDSLERLT
KRMIENGEDLFEARVNEFGVSEDWRPPAEPIGARVGNRAEKLTAKVANRY
LMAAEAEWGAPLSVNIEHVREGFISKRQAVEIDRENQKRYQRNQAVRSQI
ADHINATSGVRGSDVTRYLAIQRQNGECLYCGTAITFVNSEMDHIVPRAG
LGSTNTRDNLVATCERCNKSKSNKPFAVWAAECGIPGVSVAEALKRVDFW
IADGFASSKEHRELQKGVDKDRLKRKVSDTPEIDNRSMESVAWMARELAHRV
QYYFDEKHTGTKVRVFRGSLTSAARKASGFESRVNFIGGNGKTRLDRRHH
AMDAATVAMLRNSVAKTLVLRGNIRASERAIGAAETWKSFRGENVADRQI
FESWSENMRVLVEKFNLALYNDEVSIFSSLRLQLGNGKAHDDITITKLQMH
KVGDAWSLTEIDRASTPALWCALTRQPDFTWKDGLPANEDRTIIVNGTHY
GPLDKVGIFGKAAASLLVRGGSVDIGSAIHHARIYRIAGKKPTYGMVRVF

-continued

APDLLRYRNEDLFNVELPPQSVSMRYAEPKVREAIREGKAEYLGWLVVGD
ELLLDLSSETSGQIAELQQDFPGTTHWTVAGFFSPSRLRLRPVYLAQEGL
GEDVSEGSKSIIAGQGWRPAVNKVFGSAMPEVIRRDGLGRKRRFSYSGLP
VSWQG

SEQ ID NO: 354

MRLGLDIGTSSIGWWLYETDGAGSDARITGVVDGGVRIFSDGRDPKSGAS
LAVDRRAARAMRRRDRYLRRRATLMKVLAETGLMPADPAEAKALEALDP
FALRAAGLDEPLPLPHLGRALFHLNQRRGFKSNRKTDRGDNESGKIKDAT
ARLDMEMMANGARTYGEFLHKRRQKATDPRHVPSVRTRLSIANRGGPDGK
EEAGYDFYPDRRHLEEEFHKLWAAQGAHHPELTETLRDLLFEKIFFQRPL
KEPEVGLCLFSGHHGVPPKDPRLPKAHPLTQRRVLYETVNQLRVTADGRE
ARPLTREERDQVIHALDNKKPTKSLSSMVLKLPALAKVLKLRDGERFTLE
TGVRDAIACDPLRASPAHPDRFGPRWSILDADAQWEVISRIRRVQSDAEH
AALVDWLTEAHGLDRAHAEATAHAPLPDGYGRLGLTATTRILYQLTADVV
TYADAVKACGWHHSDGRTGECFDRLPYYGEVLERHVIPGSYHPDDDDITR
FGRITNPTVHIGLNQLRRLVNRIIETHGKPHQIVVELARDLKKSEEQKRA
DIKRIRDTTEAAKKRSEKLEELEIEDNGRNRMLLRLWEDLNPDDAMRRFC
PYTGTRISAAMIFDGSCDVDHILPYSRTLDDSFPNRTLCLREANRQKRNQ
TPWQAWGDTPHWHAIAANLKNLPENKRWRFAPDAMTRFEGENGFLDRALK
DTQYLARISRSYLDTLFTKGGHVWVPGRFTEMLRRHWGLNSLLSDAGRG
AVKAKNRTDHRHHAIDAAVIAATDPGLLNRISRAAGQGEAAGQSAELIAR
DTPPPWEGFRDDLRVRLDRIIVSHRADHGRIDHAARKQGRDSTAGQLHQE
TAYSIVDDIHVASRTDLLSLKPAQLLDEPGRSGQVRDPQLRKALRVATGG
KTGKDFENALRYFASKPGPYQAIRRVRIIKPLQAQARVPVPAQDPIKAYQ
GGSNHLFEIWRLPDGEIEAQVITSFEAHTLEGEKRPHPAAKRLLRVHKGD
MVALERDGRRVVGHVQKMDIANGLFIVPHNEANADTRNNDKSDPFKWIQI
GARPAIASGIRRVSVDEIGRLRDGGTRPI

SEQ ID NO: 355

MLHCIAVIRVPPSEEPGFFETHADSCALCHHGCMTYAANDKAIRYRVGID
VGLRSIGFCAVEVDDEDHPIRILNSVVHVHDAGTGGPGETESLRKRSGVA
ARARRRGRAEKQRLKKLDVLLEELGWGVSSNELLDSHAPWHIRKRLVSEY
IEDETERRQCLSVAMAHIARHRGWRNSFSKVDTLLLEQAPSDRMQGLKER
VEDRTGLQFSEEVTQGELVATLLEHDGDVTIRGFVRKGGKATKVHGVLEG
KYMQSDLVAELRQICRTQRVSETTFEKLVLSIFHSKEPAPSSAARQRERVG
LDELQLALDPAAKQPRAERAHPAFQKFKVVATLANMRIREQSAGERSLTS
EELNRVARYLLNHTESESPTWDDVARKLEVPRHRLRGSSRASLETGGGLT
YPPVDDTTVRVMSAEVDWLADWWDCANDESRGHMIDAISNGCGSEPDDVE
DEEVNELISSATAEDMLKLELLAKKLPSGRVAYSLKTLREVTAAILETGD
DLSQAITRLYGVDPGWVPTPAPIEAPVGNPSVDRVLKQVARWLKFASKRW
GVPQTVNIEHTREGLKSASLLEEERERWERFEARREIRQKEMYKRLGISG
PFRRSDQVRYEILDLQDCACLYCGNEINPQTFEVDHIIPRVDASSDSRRT
NLAAVCHSCNSAKGGLAFGQWVKRGDCPSGVSLENAIKRVRSWSKDRLGL
TEKAMGKRKSEVISRLKTEMPYEEFDGRSMESVAWMAIELKKRIEGYFNS
DRPEGCAAVQVNAYSGRLTACARRAAHVDKRVRLIRLKGDDGHHKNRFDR
RNHAMDALVIALMTPAIARTIAVREDRREAQQLTRAFESWKNFLGSEERM
QDRWESWIGDVEYACDRLNELIDADKIPVTENLRLRNSGKLHADQPESLK
KARRGSKRPRPQRYVLGDALPADVINRVTDPGLWTALVRAPGFDSQLGLP
ADLNRGLKLRGKRISADFPIDYFPTDSPALAVQGGYVGLEFHHARLYRII
GPKEKVKYALLRVCAIDLCGIDCDDLFEVELKPSSISMRTADAKLKEAMG
NGSAKQIGWLVLGDEIQIDPTKFPKQSIGKFLKECGPVSSWRVSALDTPS
KITLKPRLLSNEPLLKTSRVGGHESDLVVAECVEKIMKKTGWVVEINALC
QSGLIRVIRRNALGEVRTSPKSGLPISLNLR

SEQ ID NO: 356

MRYRVGLDLGTASVGAAVFSMDEQGNPMELIWHYERLFSEPLVPDMGQLK
PKKAARRLARQQRRQIDRRASRLRRIAIVSRRLGIAPGRNDSGVHGNDVP
TLRAMAVNERIELGQLRAVLLRMGKKRGYGGTFKAVRKVGEAGEVASGAS
RLEEEMVALASVQNKDSVTVGEYLAARVEHGLPSKLVAANNEYYAPEYA
LFRQYLGLPAIKGRPDCLPNMYALRHQIEHEFERIWATQSQFHDVMKDHG
VKEEIRNAIFFQRPLKSPADKVGRCSLQTNLPRAPRAQIAAQNFRIEKQM
ADLRWAGMREAEMLNDHQKAVIRELLNQQKELSFRKIYKELERAGCPGPE
GKGLNMDRAALGGRDDLSGNTTLAAWRKLGLEDRWQELDEVTQIQVINFL
ADLGSPEQLDTDDWSCRFMGKNGRPRNFSDEFVAPMNELRMTDGFDRLSK
MGFEGGRSSYSIKALKALTEWMIAPHWRETPETHRVDEEAAIRECYPESL
ATPAQGGRQSKLEPPPLTGNEVVDVALRQVRHTINMMIDDLGSVPAQIVV
EMAREMKGGVTRRNDIEKQNKRFASERRKAAQSIEENGKTPTPARILRYQ
LWIEQGHQCPYCESNISLEQALSGAYTNFEHILPRTLTQIGRKRSELVLA
HRECNDEKGNRTPYQAFGHDDRRWRIVEQRANALPKKSSRKTRLLLLKDF
EGEALTDESIDEFADRQLHESSWLAKVTTQWLSSLGSDVYVSRGSLTAEL
RRRWGLDTVIPQVRFESGMPVVDEEGAEITPEEFEKFRLQWEGHRVTREM
RTDRRPDKRIDHRHHLVDAIVTALTSRSLYQQYAKAWKVADEKQRHGRVD
VKVELPMPILTIRDIALEAVRSVRISHKGPPRYPDGRFFEATAYGIAQRLD
ERSGEKVDWLVSRKSLTDLAPEKKSIDVDKVRANISRIVGEAIRLHISNI
FEKRVSKGMTPQQALREPIEFQGNILRKVRCFYSKADDCVRIEHSSRRGH
HYKMLLNDGFAYMEVPCKEGILYGVPNLVRPSEAVGIKRAPESGDFIRFY
KGDTVKNIKTGRVYTIKQILGDGGGKLILTPVTETKPADLLSAKWGRLKV
GGRNIHLLRLCAE

SEQ ID NO: 357

MIGEHVRGGCLFDDHWTPNWGAFRLPNTVRTFTKAENPKDGSSLAEPRRQ
ARGLRRRLRRKTQRLEDLRRLLAKEGVLSLSDLETLFRETPAKDPYQLRA
EGLDRPLSFPEWVRVLYHITKHRGFQSNRRNPVEDGQERSRQEEEGKLLS
GVGENERLLREGGYRTAGEMLARDPKFQDHRRNRAGDYSHTLSRSLLLEE
ARRLFQSQRTLGNPHASSNLEEAFLHLVAFQNPFASGEDIRNKAGHCSLE
PDQIRAPRRSASAETFMLLQKTGNLRLIHRRTGEERPLTDKEREQIHLLA
WKQEKVTHKTLRRHLEIPEEWLFTGLPYHRSGDKAEEKLFVHLAGIHEIR
KALDKGPDPAVWDTLRSRRDLLDSIADTLTFYKNEDEILPRLESLGLSPE
NARALAPLSFSGTAHLSLSALGKLLPHLEEGKSYTQARADAGYAAPPPDR
HPKLPPLEEADWRNPVVFRALTQTRKVVNALVRRYGPPWCIHLETARELS
QPAKVRRRIETEQQANEKKKQQAEREFLDIVGTAPGPGDLLKMRLWREQG
GFCPYCEEYLNPTRLAEPGYAEMDHILPYSRSLDNGWHNRVLVHGKDNRD
KGNRTPFEAFGGDTARWDRLVAWVQASHLSAPKKRNLLREDFGEEAEREL
KDRNLTDTRFITKTAATLLRDRLTFHPEAPKDPVMTLNGRLTAFLRKQWG
LHKNRKNGDLHHALDAAVLAVASRSFVYRLSSHNAAWGELPRGREAENGF
SLPYPAFRSEVLARLCPTREEILLRLDQGGVGYDEAFRNGLRPVFVSRAP
SRRLRGKAHMETLRSPKWKDHPEGPRTASRIPLKDLNLEKLERMVGKDRD
RKLYEALRERLAAFGGNGKKAFVAPFRKPCRSGEGPLVRSLRIFDSGYSG
VELRDGGEVYAVADHESMVRVDVYAKKNRFYLVPVYVADVARGIVKNRAI
VAHKSEEEWDLVDGSFDFRFSLFPGDLVEIEKKDGAYLGYYKSCHRGDGR
LLLDRHDRMPRESDCGTFYVSTRKDVLSMSKYQVDPLGEIRLVGSEKPPF
VL

SEQ ID NO: 358

MEKKRKVTLGFDLGIASVGWAIVDSETNQVYKLGSRLFDAPDTNLERRTQ
RGTRRLLRRRKYRNQKFYNLVKRTEVFGLSSREAIENRFRELSIKYPNII
ELKTKALSQEVCPDEIAWILHDYLKNRGYFYDEKETKEDFDQQTVESMPS
YKLNEFYKKYGYFKGALSQPTESMEKDNKDLKEAFFFDFSNKEWLKENLY
FFNVQKNILSETFIEEEKKIFSFTRDISKGPGSDNMPSPYGIFGEFGDNG
QGGRYEHIWDKNIGKCSIFTNEQRAPKYLPSALIFNFLNELANIRLYSTD
KKNIQPLWKLSSVDKLNILLNLFNLPISEKKKKLTSTNINDIVKKESIKS
IMISVEDIDMIKDEWAGKEPNVYGVGLSGLNIEESAKENKFKFQDLKLIN
VLINLLDNVGIKFEFKDRNDIIKNLELLDNLYLFLIYQKESNNKDSSIDL
FIAKNESLNIENLKLKLKEFLLGAGNEFENHNSKTHSLSKKAIDEILPKL
LDNNEGWNLEAIKNYDEEIKSQIEDNSSLMAKQDKKYLNDNFLKDAILPP
NVKVTFQQAILIFNKIIQKFSKDFEIDKVVIELAREMTQDQENDALKGIA
KAQKSKKSLVEERLEANNIDKSVFNDKYEKLIYKIFLWISQDFKDPYTGA
QISVNEIVNNKVEIDHIIPYSLCFDDSSANKVLVHKQSNQEKSNSLPYEY
IKQGHSGWNWDEFTKYVKRVFVNNVDSILSKKERLKKSENLLTASYDGYD
KLGFLARNLNDTRYATILFRDQLNNYAEHHLIDNKKMFKVIAMNGAVTSF
IRKNMSYDNKLRLKDRSDFSHHAYDAAIIALFSNKTKTLYNLIDPSLNGI
ISKRSEGYWVIEDRYTGEIKELKKEDWTSIKNNVQARKIAKEIEEYLIDL
DDEVFFSRKTKRKTNRQLYNETIYGIATKTDEDGITNYYKKEKFSILDDK
DIYLRLLREREKFVINQSNPEVIDQIIEIIESYGKENNIPSRDEAINIKY
TKNKINYNLYLKQYMRSLTKSLDQFSEEFINQMIANKTFVKTVTKPKLTR
KIKFLRLVNDVKINDIRKNQVINKFNGKNNEPKAFYENINSLGAIVFKNS
ANNFKTLSINTQIAIFGDKNWDIEDFKTYNMEKIEKYKEIYGIDKTYNFH
SFIFPGTILLDKQNKEFYYISSIQTVRDIIEIKFLNKIEFKDENKNQDTS
KTPKRLMFGIKSIMNNYEQVDISPFGINKKIFE

SEQ ID NO: 359

MGYRIGLDVGITSTGYAVLKTDKNGLPYKILTLDSVIYPRAENPQTGASL
AEPRRIKRGLRRRTRRTKFRKQRTQQLFIHSGLLSKPEIEQILATPQAY
SVYELRVAGLDRRLTNSELFRVLYFFIGHRGFKSNRKAELNPEEADKKQ
MGQLLNSIEEIRKAIAEKGYRTVGELYLKDPKYNDHKRNKGYIDGYLSTP
NRQMLVDEIKQILDKQRELGNEKLTDEFYATYLLGDENRAGIFQAQRDFD
EGPGAGPYAGDQIKKMVGKDIFEPTEDRAAKATYTFQNYFLLQKMTSLNY
QNTTGDTWHTLNGLDRQAIIDAVFAKAEKPTKTYKPTDFGELRKLLKLPD
DARFNLVNYGSLQTQKEIETVEKKTRPVDFKAYHDLVKVLPEEMWQSRQL
LDHIGTALTLYSSDKRRRRYFAEELNLPAELIEKLLPLNFSKFGHLSIKS
MQNIIPYLEMGQVYSEATTNTGYDFRKKQISKDTIREEITNPVVRRAVTK
TIKIVEQIIRRYGKPDGINIELARELGRNFKERGDIQKRQDKNRQTNDLI
AAELTELGIPVNGQNIIRYKLHKEQNGVDPYTGDQIPFERAFSEGYEVDH
IIPYSISWDDSYTNKVLTSACNREKGNRIPMVYLANNEQRLNALTNIAD
NIIRNSRKRQKLLKQKLSDEELKDWKQRNINDTRFITRVLYNYFRQAIEF
NPELEKKQRVLPLNGEVTSKIRSRWGFLKVREDGDLNHAEIIKDATVIAAITP
KFIQQVTKSYQHQEVKNNQALWHDAEIKDAEYAAEAQRMDADLFNKIFNG
FPPLPWPEFLDELLARISDNPVEMMKSRSWNTYTPIEIAKLKPVFVVRLAN
HKISGPAHLDTIRSAKLFDEKGIVLSRVSITKLKINKKGQVATGDGIYDP
ENSNNGDKVVYSAIRQALEAHNGSGELAFPDGYLEKYTVHDGTKKLVRKVRV
AKKVSLPVRLKNKAAADNGSMVRIDVFNTGKKFVFVPIYIKDTVEQVLPN
KAIARGKSLWYQITESDQFCFSLYPGDMVHIESKTGIKPKYSNKENNTSV
VPIKNFYGYFDGADIATASILVRAHDSSYTARSIGIAGLLKFEKYQVDYF
GRYHKVHEKKRQLFVKRDE

SEQ ID NO: 360

MQKNINTKQNHIYIKQAQKIKEKLGDKPYRIGLDLGVGSIGFAIVSMEEN
DGNVLLPKEIMVGSRIFKASAGAADRKLSRGQRNNHRHTRERMRYLWKV
LAEQKLALPVPADLDRKENSSEGETSAKRFLGDVLQKDIYELRVKSLDER
LSLQELGYVLYHIAGHRGSSAIRTFENDSEEAQKENTENKKIAGNIKRLM
AKKNYRTGYELYKEFFENKEKHKREKISNAANNHKFSPTRDLVIKEAEA
ILKKQAGKDGFHKELTEEYIEKLTKAIGYESEKLIPESGFCPYLKDEKRL
PASHKLNEERRLWETLNNARYSDPIVDIVTGEITGYYEKQFTKEQKQKLF
DYLLTGSELTPAQTKKLLGLKNTNFEDIILQGRDKKAQKIKGYKLIKLES
MPFWARLSEAQQDSFLYDWNSCPDEKLLTEKLSNEYHLTEEEIDNAFNEI
VLSSSYAPLGKSAMLIILEKIKNDLSYTEAVEEALKEGKLTKEKQAIKDR
LPYYGAVLQESTQKIIAKGFSPQFKDKGYKTPHTNKYELEYGRIANPVVH
QTLNELRKLVNEIIDILGKKPCEIGLETARELKKSAEDRSKLSREQNDNE
SNRNRIYEIYIRPQQQVIITRRENPRNYILKFELLEEQKSQCPFCGGQIS
PNDIINNQADIEHLFPIAESEDNGRNNLVISHSACNADKAKRSPWAAFAS
AAKDSKYDYNRILSNVKENIPHKAWRFNQGAFEKFIENKPMAARFKTDNS
YISKVAHKYLACLFEKPNIICVKGSLTAQLRMAWGLQGLMIPFAKQLITE
KESESFNKDVNSNKKIRLDNRHHALDAIVIAYASRGYGNLLNKMAGKDYK
INYSERNWLSKILLPPNNIWENIDADLESFESSVKTALKNAFISVKHDH
SDNGELVKGTMYKIFYSERGYTLTTYKKLSALKLTDPQKKKTPKDFLETA
LLKFKGRESEMKNEKIKSAIENNKRLFDVIQDNLEKAKKLLEEENEKSKA
YDTGDSLCVDLYYDNKGKLCGEIIRKIDAQQKNPLKYKEQGFTLFERIYG
GDILEVDFDIHSDKNSFRNNTGSAPENRVFIKVGTFTEITNNNIQIWFGN
IIKSTGGQDDSFTINSMQQYNPRKLILSSCGFIKYRSPILKNKEG

SEQ ID NO: 361

MAAFKPNPINYILGLDIGIASVGWAMVEIDEDENPICLIDLGVRVFERAE
VPKTGDSLAMARRLARSVRRLTRRRAHRLLRARRLLKREGVLQAADFDEN
GLIKSLPNTPWQLRAAALDRKLTPLEWSAVLLHLIKHRGYLSQRKNEGQT
ADKELGALLKGVADNAHALQTGDFRTPAELALNKFEKESGHIRNQRGDYS
HTFSRKDLQAELILLFEKQKEFGNPHVSGGLKEGIETLLMTQRPALSGDA
VQKMLGHCTFEPAEPKAAKNTYTAERFIWLTKLNNLRILEQGSERPLTDT
ERATLMEDEPYRKSKLTYAQARKLLGLEDTAFFKGLRYGKDNAEASTLMEM
KAYHAISRALEKEGLKDKKSPLNLSPELQDEIGTAFSLFKTDEDITGRLK
DRIQPEILEALLKHISFDKFVQISLKALRRIVPLMEQGKRYDEACAEIYG
DHYGKKNTEEKIYLPPIPADEIRNPVVLRALSQARKVINGVVRRYGSPAR
IHIETAREVGKSFKDRKEIEKRQEENRKDREKAAAKFREYFPNFVGEPKS
KDILKLRLYEQQHGKCLYSGKEINLGRLNEKGYVEIDHALPFSRTWDDSF
NNKVLVLGSENQNKGNQTPYEYFNGKDNSREWQEFKARVETSRFPPRSKKQ
RILLQKFDEDGFKERNLNDTRYVNRFLCQFVADRMRLTGKGKKRVFASNG
QITNLLRGFWGLRKVRAENDRHHALDAVVVACSTVAMQQKITRFVRYKEM
NAFDGKITDKETGEVLHQKTHFPQPWEFFAQEVMIRVFGKPDGKPEFEEA
DTPEKLRTLLAEKLSSRPEAVHEYVTPLFVSRAPNRKMSGQGHMETVKSA
KRLDEGVSVLRVPLTQLKLKDLEKMVNREREPKLYEALKARLEAHKDDPA
KAFAEPFYKYDKAGNRTQQVKAVRVEQVQKTGVWVRNHNGIADNATMVRV
DVFEKGDKYYLVPIYSWQVAKGILPDRAVVQGKDEEDWQLIDDSFNFKFS
LHPNDLVEVITKKARMFGYFASCHRGTGNINIRIHDLDHKIGKNGILEGI
GVKTALSFQKYQIDELGKEIRPCRLKKRPPVR

SEQ ID NO: 362

MQTTNLSYILGLDLGIASVGWAVVEINENEDPIGLIDVGVRIFERAEVPK
TGESLALSRRLARSTRRLIRRRAHRLLLAKRFLKREGILSTIDLEKGLPN
QAWELRVAGLERRLSAIEWGAVLLHLIKHRGYLSKRKNESQTNNKELGAL
LSGVAQNHQLLQSDDYRTPAELALKKFAKEEGHIRNQRGAYTHTFNRLDL
LAELNLLFAQQHQFGNPHCKEHIQQYMTELLMWQKPALSGEAILKMLGKC
THEKNEFKAAKHTYSAERFVWLTKLNNLRILEDGAERALNEEERQLLINH
PYEKSKLTYAQVRKLLGLSEQAIFKHLRYSKENAESATFMELKAWHAIRK
ALENQGLKDDTWQDLAKKPDLLDEIGTAFSLYKTDEDIQQYLTNKVPNSVI
NALLVSLNFDKFIELSLKSLRKILPLMEQGKRYDQACREIYGHHYGEANQ
KTSQLLPAIPAQEIRNPVVRTLSQARKVINAAIRQYGSPARVHIETGRE
LGKSFKERREIQKQQEDNRTKRESAVQKFKELFSDFSSEPKSKDILKFRL
YEQQHGKCLYSGKEINIHRLNEKGYVEIDHALPFSRTWDDSFNNKVLVLA
SENQNKGNQTPYEWLQGKINSERWKNFVALVLGSQCSAAKKQRLLTQVID
DNKFIDRNLNDTRYIARFLSNYIQENLLLVGKNKKNVFTPNGQITALLRS
RWGLIKARENNNRHHALDAIVVACATPSMQQKITRFIRFKEVHPYKIENR
YEMVDQESGEIISPHFPEPWAYFRQEVNIRVFDNHPDTVLKEMLPDRPQA
NHQFVQPLFVSRAPTRKMSGQGHMETIKSAKRLAEGISVLRIPLTQLKPN
LLENMVNKEREPALYAGLKARLAEFNQDPAKAFATPFYKQGGQQVKAIRV
EQVQKSGVLVRENNGVADNASIVRTDVFIKNNKPFFLVPIYTWQVAKGILP
NKAIVAHKNEDEWEEMDEGAKFKFSLFPNDLVELKTKKEYFFGYYIGLDR
ATGNISLKEHDGEISKGKDGVYRVGVKLALSFEKYQVDELGKNRQICRPQ
QRQPVR

SEQ ID NO: 363

MGIRFAFDLGTNSIGWAVVRTGPGVFGEDTAASLDGSGVLIFKDGRNPKD
GQSLATMRRVPRQSRKRRDRFVLRRRDLLAALRKAGLFPVDVEEGRRLAA
TDPYHLRAKALDESLTPHEMGRVIFHLNQRGFRSNRKADRQDREKGKIA
EGSKRLAETLAATNCRTLGEFLWSRHRGTPRTRSPTRIRMEGEGAKALYA
FYPTREMVRAEFERLWTAQSRFAPDLLTPERHEEIAGILFRQDLAPPKI
GCCTFEPSERRLPRALPSVEARGIYERLAHLRITTGPVSDRGLTRPERDV
LASALLAGKSLTFKAVRTKLKILPHALVNFEEAGEKGLDGALTAKLLSKP
DHYGAAWHGLSFAEKDTFVGKLLDEADEERLIRRLVTENRLSEDAARRCA
SIPLADGYGRLGRTANTEILAALVEETDETGTVVTYAEAVRRAGERTGRN
WHHSDERDGVILDRLPYYGEILQRHVVPGSGEPEEKNEAARWGRLANPTV

-continued

HIGLNQLRKVVNRLIAAHGRPDQIVVELARELKLNREQKERLDRENRKNR
EENERRTAILAEHGQRDTAENKIRLRLFEEQARANAGIALCPYTGRAIGI
AELFTSEVEIDHILPVSLTLDDSLANRVLCRREANREKRRQTPFQAFGAT
PAWNDIVARAAKLPPNKRWRFDPAALERFEREGGFLGRQLNETKYLSRLA
KIYLGKICDPDRVYVTPGTLTGLLRARWGLNSILSDSNFKNRSDHRHHAV
DAVVIGVLTRGMIQRIAHDAAREDQDLDRVFRDVPVPFEDFRDHVRERV
STITVAVKPEHGKGGALHEDTSYGLVPDTDPNAALGNLVVRKPIRSLTAG
EVDRVRDRALRARLGALAAPFRDESGRVRDAKGLAQALEAFGAENGIRRV
RILKPDASVVTIADRRTGVPYRAVAPGENHHVDIVQMRDGSWRGFAASVF
EVNRPGWRPEWEVKKLGGKLVMRLHKGDMVELSDKDGQRRVKVVQQIEIS
ANRVRLSPHNDGGKLQDRHADADDPFRWDLATIPLLKDRGCVAVRVDPIG
VVTLRRSNV

SEQ ID NO: 364

MMEVFMGRLVLGLDIGITSVGFGIIDLDESEIVDYGVRLFKEGTAAENET
RRTKRGGRRLKRRRVTRREDMLHLLKQAGIISTSFHPLNNPYDVRVKGLN
ERLNGEELATALLHLCKHRGSSVETIEDDEAKAKEAGETKKVLSMNDQLL
KSGKYVCEIQKERLRTNGHIRGHENNPFKTRAYVDEAFQILSHQDLSNEL
SAIITIISRKRMYYDGPGGPLSPTPYGRYTYFGQKEPIDLIEKMRGKCSL
FPNEPRAPKLAYSAELFNLLNDLNNLSIEGEKLTSEQKAMILKIVHEKGK
ITPKQLAKEVGVSLEQIRGFRIDTKGSPLLSELTGYKMIREVLEKSNDEH
LEDHVFDEIAEILTKTKDIEGRKKQISELSSDLNEESVRHQLALGTKFTA
YHSLSFKALRLINEEMLKTELNQMQSITLFGLKQNNELSVKGMKNIQADD
TAILSPVAKRAQRETFKVVNRLREIYGEFDSIVVEMAREKNSEEQRKAIR
ERQKFFEMRNKQVADIIGDDRKINAKLREKLVLYQEQDGKTAYSLEPIDL
KLLIDDPNAYEVDHIIPISISLDDSITNKVLVTHRENQEKGNLTPISAFV
KGRFTKGSLAQYKAYCLKLKEKNIKTNKGYRKKVEQYLLNENDIYKYDIQ
KEFINRNLVDTSYASRVVLNTLTTYFKQNEIPTKVFTVKGSLTNAFRRKI
NLKKDRDEDYGHHAIDALIIASMPKMRLLSTIFSRYKIEDIYDESTGEVF
SSGDDSMYYDDRYFAFIASLKAIKVRKFSHKIDTKPNRSVADETIYSTRV
IDGKEKVVKKYKDIYDPKFTALAEDILNNAYQEKYLMALHDPQTFDQIVK
VVNYYFEEMSKSEKYFTKDKKGRIKISGMNPLSLYRDEHGMLKKYSKKGD
GPAITQMKYFDGVLGNHIDISAHYQVRDKKVVLQQISPYRTDFYYSKENG
YKFVTIRYKDVRWSEKKKKYVIDQQDYAMKKAEKKIDDTYEFQFSHMRDE
LIGITKAEGEALIYPDETWHNFNFFFHAGETPEILKFTATNNDKSNKIEV
KPIHCYCKMRLMPTISKKIVRIDKYATDVVGNLYKVKKNTLKFEFD

SEQ ID NO: 365

MKKILGVDLGITSFGYAILQETGKDLYRCLDNSVVMRNNPYDEKSGESSQ
SIRSTQKSMRRLIEKRKKRIRCVAQTMERYGILDYSETMKINDPKNNPIK
NRWQLRAVDAWKRPLSPQELFAIFAHMAKHRGYKSIATEDLIYELELELG
LNDPEKESEKKADERRQVYNALRHLEELRKKYGGETIAQTIHRAVEAGDL
RSYRNHDDYEKMIRREDIEEEIEKVLRQAELGALGLPEEQVSELIDELK
ACITDQEMPTIDESLFGKCTFYKDELAAPAYSYLYDLYRLYKKLADLNID
GYEVTQEDREKVIEWVEKKIAQGKNLKKITHKDLRKILGLAPEQKIFGVE
DERIVKGKKEPRTFVPFFFLADIAKFKELFASIQKHPDALQIFRELAEIL
QRSKTPQEALDRLRALMAGKGIDTDRELLELFKNKRSGTRELSHRYILE
ALPLFLEGYDEKEVQRILGFDDREDYSRYPKSLRHLHLREGNLFEKEENP
INNHAVKSLASWALGLIADLSWRYGPPFDEIILETTRDALPEKIRKEIDKA
MREREKALDKIIGKYKKEFPSIDKRLARKIQLWERQKGLDLYSGKVINLS
QLLDGSADIEHIVPQSLGGLSTDYNTIVTLKSVNAAKGNRLPLGPDWLAGNP
DYRERIGMLSEKGLIDWKKRKNLLAQSLDEIYTENTHSKGIRATSYLEAL
VAQVLKRYYPFPDPELRKNGIGVRMIPGKVTSKTRSLLGIKSKSRETNFH
HAEDALILSTLTRGWQNRLHRMLRDNYGKSEAELKELWKKYMPHIEGLTL
ADYIDEAFRRFMSKGEESLFYRDMFDTIRSISYWVDKKPLSASSHKETVY
SSRHEVPTLRKNILEAFDSLNVIKDRHKLTTEEFMKRYDKEIRQKLWLHR
IGNTNDESYRAVEERATQIAQILTRYQLMDAQNDKEIDEKFQQALKELIT
SPIEVTGKLLRKMRFVYDKLNAMQIDRGLVETDKNMLGIHISKGPNEKLI
FRRMDVNNAHELQKERSGILCYLNEMLFIFNKKGLIHYGCLRSYLEKGQG
SKYIALFNPRFPANPKAQPSKFTSDSKIKQVGIGSATGIIKAHLDLDGHV
RSYEVFGTLPEGSIEWFKEESGYGRVEDDPHH

SEQ ID NO: 366

MRPIEPWILGLDIGTDSLGWAVFSCEEKGPPTAKELLGGGVRLFDSGRDA
KDHTSRQAERGAFRRARRQTRTWPWRRDRLIALFQAAGLTPPAAETRQIA
LALRRREAVSRPLAPDALWAALLHLAHHRGFRSNRIDKRERAAAKALAKAK
PAKATAKATAPAKEADDEAGFWEGAEAALRQRMAASGAPTVGALLADDLD
RGQPVRMRYNQSDRDGVVAPTIALIAEELAEIVARQSSAYPGLDWPAVTR
LVLDQRPLRSKGAGPCAFLPGEDRALRALPTVQDFIIRQTLANLRLPSTS
ADEPRPLTDEEHAKALALLSTARFVEWPALRRALGLKRGVKFTAETERNG
AKQAARGTAGNLTEAILAPLIPGWSGWDLDRKDRVFSDLWAARQDRSALL
ALIGDPRGPTRVTEDETAEAVADAIQIVLPTGRASLSAKAARAIAQAMAP
GIGYDEAVTLALGLHHSHRPQERLARLPYYAAALPDVGLDGDPVGPPPA
EDDGAAAEAYYGRIGNISVHIALNETRKIVNALLHRHGPILRLVMVETTR
ELKAGADERKRMIAEQAERERENAEIDVELRKSDRWMANARERRQRVRLA
RRQNNLCPYTSTPIGHADLLGDAYDIDHVIPLARGGRDSLDNMVLCGSDA
NKTKGDKTPWEAFHDKPGWIAQRDDFLARLDPQTAKALAWRFADDAGERV
ARKSAEDEDQGFLPRQLTDTGYIARVALRYLSLVTNEPNAVVATNGRLTG
LLRRLAWDITPGAPAPRDLLPTPRDALRDDTAARRFLDGLTPPPLAKAVEGA
VQARLAALGRSRVADAGLADALGLTLASLGGGGKNRADHRHHFIDAMIA
VTTRGLINQINQASGAGRILDLRKWPRTNFEPPYPTFRAEVMKQWDHIHP

SIRPAHRDGGSLHAATVFGVRNRPDARVLVQRKPVEKLFLDANAKPLPAD
KIAEIIDGFASPRMAKRFKALLARYQAAHPEVPPALAALAVARDPAFGPR
GMTANTVIAGRSDGDGEDAGLITPFRANPKAAVRTMGNAVYEVWEIQVKG
RPRWTHRVLTRFDRTQPAPPPPPENARLVMRLRRGDLVYWPLESGDRLFL
VKKMAVDGRLALWPARLATGKATALYAQLSCPNINLNGDQGYCVQSAEGI
RKEKIRTTSCTALGRLRLSKKAT

SEQ ID NO: 367

MKYTLGLDVGIASVGWAVIDKDNNKIIDLGVRCFDKAEESKTGESLATAR
RIARGMRRRISRRSQRLRLVKKLFVQYEIIKDSSEFNRIFDTSRDGWKDP
WELRIYNALSRILKPYELVQVLTHITKRRGFKSNRKEDLSTTKEGVVITSI
KNNSEMLRTKNYRTIGEMIFMETPENSNKRNKVDEYIHTIAREDLLNEIK
YIFSIQRKLGSPFVTEKLEHDFLNIWEFQRPFASGDSILSKVGKCTLLKE
ELRAPTSCYTSEYFGLLQSINNLVLVEDNNTLTLNNDQRAKIIEYAHFKN
EIKYSEIRKLLDIEPEILFKAHNLTHKNPSGNNESKKFYEMKSYHKLKST
LPTDIWGKLHSNKESLDNLFYCLTVYKNDNEIKDYLQANNLDYLIEYIAK
LPTFNKFKHLSLVAMKRIIPFMEKGYKYSDACNMAELDFTGSSKLEKCNK
LTVEPIIENVTNPVVIRALTQARKVINAIIQKYGLPYMVNIELAREAGMT
RQDRDNLKKEHENNRKAREKISDLIRQNGRVASGLDILKWRLWEDQGGRC
AYSGKPIPVCDLLNDSLTQIDHIYPYSRSMDDSYMNKVLVLTDENQNKRS
YTPYEVWGSTEKWEDFEARIYSMHLPQSKEKERLLNRNFITKDLDSFISRN
LNDTRYISRFLKNYIESYLQFSNDSPKSCVVCVNGQCTAQLRSRWGLNKN
REESDLHHALDAAVIACADRKIIKEITNYYNERENHNYKVKYPLPWHSFR
QDLMETLAGVFISRAPRRKITGPAHDETIRSPKHFNKGLTSVKIPLTTVT
LEKLETMVKNTKGGISDKAVYNVLKNRLIEHNNKPLKAFAEKIYKPLKNG
TNGAIIRSIRVETPSYTGVFRNEGKGISDNSLMVRVDVFKKKDKYYLVPI
YVAHMIKKELPSKAIVPLKPESQWELIDSTHEFLFSLYQNDYLVIKTKKG
ITEGYYRSCHRGTGSLSLMPHFANNKNVKIDIGVRTAISIEKYNVDILGN
KSIVKGEPRRGMEKYNSFKSN

SEQ ID NO: 368

MIRTLGIDIGIASIGWAVIEGEYTDKGLENKEIVASGVRVFTKAENPKNN
ESLALPRTLARSARRRNARKKGRIQQVKHYLSKALGLDLECFVQGEKLAT
LFQTSKDFLSPWELRERALYRVLDKEELARVILHIAKRRGYDDITYGVED
NDSGKIKKAIAENSKRIKEEQCKTIGEMMYKLYFQKSLNVRNKKESYNRC
VGRSELREELKTIFQIQQELKSPWVNEELIYKLLGNPDAQSKQEREGLIF
YQRPLKGFGDKIGKCSHIKKGENSPYRACKHAPSAEEFVALTKSINFLKN
LTNRHGLCFSQEDMCVYLGKILQEAQKNEKGLTYSKLKLLLDLPSDFEFL
GLDYSGKNPEKAVFLSLPSTFKLNKITQDRKTQDKIANILGANKDWEAIL
KELESLQLSKEQIQTIKDAKLNFSKHINLSLEALYHLLPLMREGKRYDEG
VEILQERGIFSKPQPKNRQLLPPLSELAKEESYFDIPNPVLRRALSEFRK
VVNALLEKYGGFHYPHIELTRDVCKAKSARMQLEKINKKNKSENDAASQL
LEVLGLPNTYNNRLKCKLWKQQEEYCLYSGEKITIDHLKDQRALQIDHAF
PLSRSLDDSQSNKVLCLTSSNQEKSNKTPYEWLGSDEKKWDMYVGRVYSS
NFSPSKKRKLTQKNFKERNEEDFLARNLVDTGYIGRVTKEYIKHSLSFLP
LPDGKKEHIRIISGSMTSTMRSFWGVQEKNRDHHLHHAQDAIIIACIEPS
MIQKYTTYLKDETHERLKSHQKAQILREGDHKLSLRWPMSNFKDKIQESI
QNIIPSHHVSHKVTGELHQETVRTKEFYYQAFGGEEGVKKALKFGKIREI
NQGIVDNGAMVRVDIFKSKDKGKFYAVPIYTYDFAIGKLPNKAIVQGKKN
GIIKDWLEMDENYEFCFSLFKNDCIKIQTKEMQEAVLAIYKSTNSAKATI
ELEHLSKYALKNEDEEKMFTDTDKEKNKTMTRESCGIQGLKVFQKVKLSV
LGEVLEHKPRNRQNIALKTTPKHV

SEQ ID NO: 369

MKYSIGLDIGIASVGWSVINKDKERIEDMGVRIFQKAENPKDGSLASSR
REKRGSRRRNRRKKHRLDRIKNILCESGLVKKNEIEKIYKNAYLKSPWEL
RAKSLEAKISNKEIAQILLHIAKRRGFKSPRKTDRNADDTGKLLSGIQEN
KKIMEEKGYLTIGDMVAKDPKFNTHVRNKAGSYLFSFSRKLLEDEVRKIQ
AKQKELGNTHFTDDVLEKYIEVFNSQRNFDEGPSKPSPYYSEIGQIAKMI
GNCTFESSEKRTAKNTWSGERVFVLQKLNNFRIVGLSGKRPLTEEERDIV
EKEVYLKKEVRYEKLRKILYLKEEERFGDLNYSKDEKQDKKTEKTKFISL
IGNYTIKKLNLSEKLKSEIEEDKSKLDKIIEILTFNKSDKTIESNLKKLE
LSREDIEILLSEEFSGTLNLSLKAIKKILPYLEKGLSYNEACEKADYDYK
NNGIKFKRGELLPVVDKDLIANPVVLRAISQTRKVVNAIIRKYGTPHTIH
VEVARDLAKSYDDRQTIIKENKKRELENEKTKKFISEEFGIKNVKGKLLL
KYRLYQEQEGRCAYSRKELSLSEVILDESMTDIDHIIPYSRSMDDSYSNK
VLVLSGENRKKSNLLPKEYFDRQGRDWDTFVLNVKAMKIHPRKKSNLLKE
KFTREDNKDWKSRALNDTRYISRFVANYLENALEYRDDSPKKRVFMIPGQ
LTAQLRARWRLNKVRENGDLHHALDAAVVAVTDQKAINNISNISRYELK
NCKDVIPSIEYHADEETGEVYFEEVKDTRFPMPWSGFDLELQKRLESENP
REEFYNLLSDKRYLGWFNYEEGFIEKLRPVFVSRMPNRGVKGQAHQETIR
SSKKISNQIAVSKKPLNSIKLKDLEKMQGRDTDRKLYEALKNRLEEYDDK
PEKAFAEPFYKPTNSGKRGPLVRGILKVEEKQNVGVYVNGGQASNGSMVRI
DVFRKNGKFYTVPIYVHQTLLKELPNRAINGKPYKDWDLIDGSFEFLYSF
YPNDLIEIEFGKSKSIKNDNKLTKTEIPEVNLSEVLGYYRGMDTSTGAAT
IDTQDGKIQMRIGIKTVKNIKKYQVDVLGNVYKVKREKRQTF

SEQ ID NO: 370

MSKKVSRRYEEQAQEICQRLGSRPYSIGLDLGVGSIGVAVAAYDPIKKQP
SDLVFVSSRIFIPSTGAAERRQKRGQRNSLRHRANRLKFLWKLLAERNLM
LSYSEQDVPDPARLRFEDAVVRANPYELRLKGLNEQTLTSELGYALYHIA

-continued

NHRGSSSVRTFLDEEKSSDDKKLEEQQAMTEQLAKEKGISTFIEVLTAFN
TNGLIGYRNSESVKSKGVPVPTRDIISNEIDVLLQTQKQFYQEILSDEYC
DRIVSAILFENEKIVPEAGCCPYFPDEKKLPRCHFLNEERRLWEAINNAR
IKMPMQEGAAKRYQSASFSDEQRHILFHIARSGTDITPKLVQKEFPALKT
SIIVLQGKEKAIQKIAGFRFRRLEEKSFWKRLSEEQKDDTFKYTNTPDD
KRLSKYLMKHLLLTENEVVDALKTVSLIGDYGPIGKTATQLLMKHLEDGL
TYTEALERGMETGEFQELSVWEQQSLLPYYGQILTGSTQALMGKYWHSAF
KEKRDSEGFFKPNTNSDEEKYGRIANPVVHQTLNELRKLMNELITILGAK
PQEITVELARELKVGAEKREDIIKQQTKQEKEAVLAYSKYCEPNNLDKRY
IERFRLLEDQAFVCPYCLEHISVADIAAGRADVDHIFPRDDTADNSYGNK
VVAHRQCNDIKGKRTPYAAFSNTSAWGPIMHYLDETPGMWRKRRKFETNE
EEYAKYLQSKGFVSRFESDNSYIAKAAKEYLRCLFNPNNVTAVGSLKGME
TSILRKAWNLQGIDDLLGSRHWSKDADTSPTMRKNRDDNRHHGLDAIVAL
YCSRSLVQMINTMSEQGKRAVEIEAMIPIPGYASEPNLSFEAQRELFRKK
ILEFMDLHAFVSMKTDNDANGALLKDTVYSILGADTQGEDLVFVVKKKIK
DIGVKIGDYEEVASAIRGRITDKQPKWYPMEMKDKIEQLQSKNEAALQKY
KESLVQAAAVLEESNRKLIESGKKPIQLSEKTISKKALELVGGYYYLISN
NKRTKTFVVKEPSNEVKGFARFDITKSGKPQFTEFKLYHDLKSVLFDQS
NPSYKPAYMKQGYSLYVRLYQGDVCELRASDLTEAESNLAKTTHVRLPNA
KPGRTFVIIITFTEMGSGYQIYFSNLAKSKKGQDTSFTLTTIKNYDVRKV
QLSSAGLVRYVSPLLVDKIEKDEVALCGE

SEQ ID NO: 371
MNQKFILGLDIGITSVGYGLIDYETKNIIDAGVRLFPEANVENNEGRRSK
RGSRRLKRRIHRLERVKKLLEDYNLLDQSQIPQSTNPYAIRVKGLSEAL
SKDELVIALLHIAKRRGIHKIDVIDSNDDVGNELSTKEQLNKNSKLLKDK
FVCQIQLERMNEGQVRGEKNRFKTADIIKEIIQLLNVQKNFHQLDENFIN
KYIELVEMRREYFEGPGKGSPYGWEGDPKAWYETLMGHCTYPPDELRSVK
YAYSADLFNALNDLNNLVIQRDGLSKLEYHEKYHIIENVFKQKKKPTLKQ
IANEINVNPEDIKGYRITKSGKPQFTEFKLYHDLKSVLFDQSILENEDVL
DQIAEILTIYQDKDSIKSKLTELDILLNEEDKENIAQLTGYTGTHRLSLK
CIRLVLEEQWYSSRNQMEIFTHLNIKPKKINLTAANKIPKAMIDEFILSP
VVKRTFGQAINLINKIIEKYGVPEDIIIELARENNSKDKQKFINEMQKKN
ENTRKRINEIIGGKYGNQNAKRLVEKIRLHDEQEGKCLYSLEGIFLLLNN
NPNHYEVDHIIPRSVSFDNSYHNKVLVKQSENSKKSNLTPYQYFNSGKSK
LSYNQFKQHILNLSKSQDRISKKKKEYLLEERDINKFEVQKEFINRNLVD
TRYATRELTNYLKAYFSANNMNVKVKTINGSFTDYLRKVWKFKKERNHGY
KHHAEDALIIANADFLFKENKKLKAVNSVLEKPEIESKQLDIQVDSEDNY
SEMFIIPKQVQDILKDFRNFKYSHRVDKKPNRQLINDTLYSTRKKDNSTYI
VQTIKDIYAKDNTTLKKQFDKSPEKFLMYQHDPRTFEKLEVIMKQYANEK
NPLAKYHEETGEYLTKYSKKNNGPIVKSLKYIGNKLGSHLDVTHQFKSST
KKLVKLSIKPYRFDVYLTDKGYKFITISYLDVLKKDNYYYIPEQKYDKLK
LGKAIDKNAKFIASFYKNDLIKLDGEIYKIIGVNSDTRNMIELDLPDIRY
KEYCELNNIKGEPRIKKTIGKKVNSIEKLTTDVLGNVFTNTQYTKPQLLF
KRGN

SEQ ID NO: 372
MIMKLEKWRLGLDLGTNSIGWSVFSLDKDNSVQDLIDMGVRIFSDGRDPK
TKEPLAVARRTARSQRKLIYRRKLRRKQVFKPLQEQGLFPKTKEECMTLK
SLNPYELRIKALDEKLEPYELGRALFNLAVRRGFKSNRKDGSREEVSEKK
SPDEIKTQADMQTHLEKAIKENGCRTITEFLYKNQGENGGIRFAPGRMTY
YPTRKMYEEEFNLIRSKQEKYYPQVDWDDIYKAIFYQRPLKPQQRGYCIY
ENDKERTFKAMPCSQKLRILQDIGNLAYYEGGSKKRVELNDNQDKVLYEL
LNSKDKVTFDQMRKALCLADSNSFNLEENRDFLIGNPTAVKMRSKNRFGK
LWDEIPLEEQDLIIETIITADEDDAVYEVIKKYDLTQEQRDFIVKNTILQ
SGTSMLCKEVSEKLVKRLEEIADLKYHEAVESLGYKFADQTVEKYDLLPY
YGKVLPGSTMEIDLSAPETNPEKHYGKISNPTVHVALNQTRVVVNALIKE
YGKPSQIAIELSRDLKNNVEKKAEIARKQNQRAKENIAINDTISALYHTA
FPGKSFYPNRDRMKYRLWSELGLGNKCIYCGKGISGAELFTKTKEIEIEHI
LPFSRTLLDAESNLTVAHSSCNAFKAERSPFEAFGTNPSGYSWQEIIQRA
NQLKNTSKKNKFSPNAMDSFEKDSSFIARQLSDNQYIAKAALRYLKCLVE
NPSDVWTTNGSMTKLLRDKWEMDSILCRKFTEKEVALLGLKPEQIGNYKK
NRFDHRHHAIDAVVIGLTDRSMVQKLATKNSHKGNRIEIPEPPILRSDLI
EKVKNIVVSFKPDHGAEGKLSKETLLGKIKLHGKETFVCRENIVSLSEKN
LDDIVDEIKSKVKDYVAKHKGQKIEAVLSDFSKENGIKKVRCVNRVQTPI
EITSGKISRYLSPEDYFAAVIWEIPGEKKTFKAQYIRRNEVEKNSKGLNV
VKPAVLENGKPHPAAKQVCLLHKDDYLEFSDKGKMYFCRIAGYAATNNKL
DIRPVYAVSYCADWINSTNETMLTGYWKPTPTQNWVSVNVLFDKQKARLV
TVSPIGRVFRK

SEQ ID NO: 373
MSSKAIDSLEQLDLFKPQEYTLGLDLGIKSIGWAILSGERIANAGVYLFE
TAEELNSTGNKLISKAAERGRKRRIRRMLDRKARRGRHIRYLLEREGLPT
DELEEVVHQSNRTLWDVRAEAVERKLTKQELAAVLFHLVRHRGYFPNTK
KLPPDDESDSADEEQGKINRATSRLREEKLASDCKTIGQFLAQNRDRQRN
REGDYSNLMARKLVFEEALQIAEQYAKLLSDKBFEKTYLDVLMGQNSR
SPKLGNCSLIPSELRAPSSAPSTEWFKFLQNLGNLQINSNAYREEWSIDA
PRRAQIIDACSQRSTSSYWQIRRDFQIPDEYRFNLVNYERRDPDVDLQEY
LQQQERKTLANFRNWKLQEKIIGTGHPIQTLDEAARLITLIKDDEKLSDQ
LADLLLPEASDKAITQLCELDFTTAAKISLEAMYRILPHMNQGMGFFDACQ
QESLPEIGVPPAGDRVPPFDEMYNPVVNRVLSQSRKLINAVIDEYGMPAK

SEQ ID NO: 374
MRSLRYRLALDLGSTSLGWALFRLDACNRPTAVIKAGVRIFSDGRNPKDG
SSLAVTRRAARAMRRRRDRLLKRKTRMQAKLVEHGFFPADAGKRKALEQL
NPYALRAKGLQEALLPGEFARALFHINQRRGFKSNRKTDKKDNDSGVLKK
AIGQLRQQMAEQGSRTVGEYLWTRLQQGQGVRARYREKPYTTEEGKKRID
KSYDLYIDRAMIEQEFDALWAAQAAFNPTLFHEAARADLKDTLLHQRPLR
PVKPGRCTLLPEEERAPLALPSTQRFRIHQEVNHLRLLDENLREVALTLA
QRDAVVTALETKAKLSFEQIRKLLKLSGSVQFNLEDAKRTELKGNATSAA
LARKELFGAAWSGFDEALQDEIVWQLVTEEGEGALIAWLQTHTGVDEARA
QAIVDVSLLPEGYGNLGSRKALARIVPALRAAVITYDKAVQAAGFDHHSQLG
FEYDASEVEDLVHPETGEIRSVFKQLPYYGKALQRHVAFGSGKPEDPDEK
RYGKIANPTVHIGLNQVRMVVNALIRRYGRPTEVVIELARDLKQSREQKV
EAQRRQADNQRRNARIRRSIAEVLGIGEERVRGSDIQKWICWEELSFDAA
DRRCPYSGVQISAAMLLSDEVEVEHILPFSKTLDDSLNNRTVAMRQANRI
KRNRTPWDARAEFEAQGWSYEDILQRAERMPLRKRYRFAPDGYERWLGDD
KDFLARALNDTRYLSRVAAEYLRLVCPGTRVIPGQLTALLRGKFGLNDVL
GLDGEKNRNDHRHHAVDACVIGVTDQGLMQRFATASAQARGDGLTRLVDG
MPMMPWPTDHVERAVRHIWVSHRPDHGFEGAMMEETSYGIRKDGSIKQR
RKADGSAGREISNLIRIHEATQPLRHGVSADGQPLAYKGYVGGSNYCIEI
TVNDKGKWEGEVISTFRAYGVVRAGGMGRLRNPHEGQNGRKLIMRLVIGD
SVRLEVDGAERTMRIVKISGSNGQIFMAPIHEANVDARNTDKQDAFTYTS
KYAGSLQKAKTRRVTISPIGEVRDPGFKG

SEQ ID NO: 375
MARPAFRAPRREHVNGWTPDPHRISKPFFILVSWHLLSRVVIDSSSGCFP
GTSRDHTDKFAEWECAVQPYRLSFDLGTNSIGWGLLNLDRQGKPREIRAL
GSRIFSDGRDPQDKASLAVARRLARQMRRRRDRYLTRRTRLMGALVRFGL
MPADPAARKRLEVAVDPYLARERATRERLEPFEIGRALFHLNQRRGYKPV
RTATKPDEEAGKVKEAVERLEAAIAAAGAPTLGAWFAWRKTRGETLRARL
AGKGKEAAYPFYPARRMLEAEFDTLWAEQARHHPDLLTAEAREILRHRIF
HQRPLKPPPVGRCTLYPDDGRAPRALPSAQRLRLFQELASLRVIHLDLSE
RPLTPAERDRIVAFVQGRPPKAGRKPGKVQKSVPFEKLRGLLLELPPGTGF
SLESDKRPELLGDETGARIAPAFGPGWTALPLEEQDALVELLLTEAEPER
AIAALTARWALDEATAAKLAGATLPDFHGRYGRRAVAELLPVLERETRGD
PDGRVRPIRLDEAVKLLRGGKDHSDFSREGALLDALPYYGAVLERNVAFG
TGNPADPEEKRVGRVANPTVHIALNQLRHLVNAILARHGRPEEIVIELAR
DLKRSAEDRRREDKRQADNQKRNEERKRLILSLGERPTPRNLLKLRLWEE
QGPVENRRCPYSGETISMRMLLSEQVDIDHILPFSVSLDDSAANKVVCLR
EANRIKRNRSPWEAFGHDSERWAGILARAEALPKNKRWRFAPDALEKLEG
EGGLRARHLNDTRHLSRLAVEYLRCVCPKVRVSPGRLTALLRRRWGIDAI
LAEADGPPPEVPAETLDPSPAEKNRADHRHHALDAVVIGCIDRSMVQRVQ
LAAASAEREAAAREDNIRRVLEGFKEEPWDGFRAELERRARTIVVSHRPE
HGIGGALHKETAYGPVDPPEEGFNLVVRKPIDGLSKDEINSVRDPRLRRA
LIDRLAIRRRDANDPATALAKAEDLAAQPASRGIRRVRVLKKESNPIRV
EHGGNPSGPRSGGPPHKLLLAGEVHHVDVALRADGRRWVGHWVTLFEAHG
GRGADGAAAPPRLGDGERFLMRLHKGDCLKLEHKGRVRVMQVVKLEPSSN
SVVVVEPHQVKTDRSKHVKISCDQLRARGARRVTVDPLGRVRVHAPGARV
GIGGDAGRTAMEPAEDIS

SEQ ID NO: 376
MKRTSLRAYRLGVDLGANSLGWFVVWLDDHGQPEGLGPGGVRIFPDGRNP
QSKQSNAAGRRLARSARRRRDRYLQRRGKLMGLLVKHGLMPADEPARKRL
ECLDPYGLRAKALDEVLPLHHVGRALFHLNQRRGLFANRAIEQGDKLDSA
IKAAAGRLQTSMQACGARTLGEFLNRRHQLRATVRARSPVGGDVQARYEF
YPTRAMVDAEFEAIWAAQAPHHPTMTAEAHDTIREAIFSQRAMKRPSIGK
CSLDPATSQDVDGFRCAWSHPLAQRFRIWQDVRNLAVVETGPTSRLGK
EDQDKVARALLQTDQLSFDEIRGLLGLPSDARFNLESDRRDHLKGDATGA
ILSARRHFGPAWHDRSLDRQIDIVALLESALDEAAIIASLGTTHSLDEAA
AQRALSALLPDGYCRLGLRAIKRVLPLMEAGRTYAEAASAAGYDHALLPG
GKLSLPTGLPYYGQWLQDNDVVGSDERDTNERRWGRLPNPTVHIGIGQLK
RVVNELIRWHGPPAEITVELTRDLKLSPRRLAELEREQAENQRKNDKRTS
LLRKLGLPASTHNLLKLRLWDEQGDVASECPYTGEAIGLERLVSDDVDID
HLIPFSISWDDSAANKVVCMRYANREKGNRTPFEAFGHRQGRPYDWADIA
ERAARLRPGRWRFGPGARAQFEELGDFQARLLNETSWLARVAKQYLAAV
THPHRIHVLPGRLTALLRATWELNDLLPGSDDRAAKSRDHRHHAIDALV
AALTDQALLRRMANAHDDTRRKIEVLLPPWTFRIDLETRLKAMLVSHKPD
HGLQARLHEDTAYGTVEHPETEDGANLVYRKTFVDISEKEIDRIRDRRLR
DLVRAHVAGERQQGKTLKAAVLSFAQRRDIAGHPNGIRHVRLTKSIKPDY
LVPIRDKAGRIYKSYNAGENAFVDILQAESGRWIARATTVFQANQANESH

-continued
DAPAAQPIMRVFKGDMLRIDHAGAEKFVKIVRLSPSNNLLYLVEHHQAGV
FQTRHDDPEDSFRWLFASFDKLREWNAELVRIDTLGQPWRRKRGLETGSE
DATRIGWTRPKKWP SEQ ID NO: 377
MERIFGFDIGTTSIGFSVIDYSSTQSAGNIQRLGVRIFPEARDPDGTPLN
QQRRQKRMMRRQLRRRRIRRKALNETLHEAGFLPAYGSADWPVVMADEPY
ELRRRGLEEGLSAYEFGRAIYHLAQHRHFKGRELEESDTPDPDVDDEKEA
ANERAATLKALKNEQTTLGAWLARRPPSDRKRGIHAHRNVVAEEFERLWE
VQSKFHPALKSEEMRARISDTIFAQRPVFWRKNTLGECRFMPGEPLCPKG
SWLSQQRRMLEKLNNLAIAGGNARPLDAEEERDAILSKLQQQASMSWPGVR
SALKALYKQRGEPGAEKSLKFNLELGGESKLLGNALEAKLADMFGPDWPA
HPRKQEIRHAVHERLWAADYGETPDKKRVIILSEKDRKAHREAAANSFVA
DFGITGEQAAQLQALKLPTGWEPYSIPALNLFLAELEKGERFGALVNGPD
WEGWRRTNFPHRNQPTGEILDKLPSPASKEERERISQLRNPTVVRTQNEL
RKVVVNNLIGLYGKPDRIRIEVGRDVGKSKREREEIQSGIRRNEKQRKKAT
EDLIKNGIANPSRDDVEKWILWKEGQERCPYTGDQIGFNALFREGRYEVE
HIWPRSRSFDNSPRNKTLCRKDVNIEKGNRMPFEAFGHDEDRWSAIQIRL
QGMVSAKGGTGMSPGKVKRFLAKTMPEDFAARQLNDTRYAAKQILAQLKR
LWPDMGPEAPVKVEAVTGQVTAQLRKLWTLNNILADDGEKTRADHRHHAI
DALTVACTHPGMTNKLSRYWQLRDDPRAEKPALTPPWDTIRADAEKAVSE
IVVSHRVRKKVSGPLHKETTYGDTGTDIKTKSGTYRQFVTRKKIESLSKG
ELDEIRDPRIKEIVAAHVAGRGGDPKKAFPPYPCVSPGGPEIRKVRLTSK
QQLNLMAQTGNGYADLGSNHHIAIYRLPDGKADFEIVSLFDASRRLAQRN
PIVQRTRADGASFVMSLAAGEAIMIPEGSKKGIWIVQGVWASGQVVLERD
TDADHSTTTRPMPNPILKDDAKKVSIDPIGRVRPSND SEQ ID NO: 378
MNKRILGLDTGTNSLGWAVVDWDEHAQSYELIKYGDVIFQEGVKIEKGIE
SSKAAERSGYKAIRKQYFRRRLRKIQVLKVLVKYHLCPYLSDDDLRQWHL
QKQYPKSDELMLWQRTSDEEGKNPYYDRHRCLHEKLDLTVEADRYTLGRA
LYHLTQRRGFLSNRLDTSADNKEDGVVKSGISQLSTEMEEAGCEYLGDYF
YKLYDAQGNKVRIRQRYTDRNKHYQHEFDAICEKQELSSELIEDLQRAIF
FQLPLKSQRHGVGRCTFERGKPRCADSHPDYEEFRMLCFVNNIQVKGPHD
LELRPLTYEEREKIEPLFFRKSKPNFDFEDIAKALAGKKNYAWIHDKEER
AYKFNYRMTQGVPGCPTIAQLKSIFGDDWKTGIAETYTLIQKKNGSKSLQ
EMVDDVWNVLYSFSSVEKLKEFAHHKLQLDEESAEKFAKIKLSHSFAALS
LKAIRKFLPFLRKGMYYTHASFFANIPTIVGKEIWNKEQNRKYIMENVGE
LVFNYQPKHREVQGTIEMLIKDFLANNFELPAGATDKLYHPSMIETYPNA
QRNEFGILQLGSPRTNAIRNPMAMRSLHILRRVVNQLLKESIIDENTEVH
VEYARELNDANKRRAIADRQKEQDKQHKKYGDEIRKLYKEETGKDIEPTQ
TDVLKFQLWEEQNHHCLYTGEQIGITDFIGSNPKFDIEHTIPQSVGGDST
QMNLTLCDNRFNREVKKAKLPTELANHEEILTRIEPWKNKYEQLVKERDK
QRTFAGMDKAVKDIRIQKRHKLQMEIDYWRGKYERFTMTEVPEGFSRRQG
TGIGLISRYAGLYLKSLFHQADSRNKSNVYVVKGVATAEFRKMWGLQSEY
EKKCRDNHSHHCMDAITIACIGKREYDLMAEYYRMEETFKQGRGSKPKFS
KPWATFTEDVLNIYKNLLVVHDTPNNMPKHTKKYVQTSIGKVLAQGDTAR
GSLHLDTYYGAIERDGEIRYVVRRPLSSFTKPEELENIVDETVKRTIKEA
IADKNFKQAIAEPIYMNEEKGILIKKVRCFAKSVKQPINIRQHRDLSKKE
YKQQYHVMNENNYLLAIYEGLVKNKVVREFEIVSYIEAAKYYKRSQDRNI
FSSIVPTHSTKYGLPLKTKLLMGQLVLMFEENPDEIQVDNTKDLVKRLYK
VVGIEKDGRIKFKYHQEARKEGLPIFSTPYKNNDDYAPIFRQSINNINIL
VDGIDFTIDILGKVTLKE SEQ ID NO: 379
MNYKMGLDIGIASVGWAVINLDLKRIEDLGVRIFDKAEHPQNGESLALPR
RIARSARRRLRRRKHRLERIRRLLVSENVLTKEEMNLLFKQKKQIDVWQL
RVDALERKLNNDELARVLLHLAKRRGFKSNRKSERNSKESSEFLKNIEEN
QSILAQYRSVGEMIVKDSKFAYHKRNKLDSYSNMIARDDLEREIKLIFEK
QREFNNPVCTERLEEKYLNIWSSQRPFASKEDIEKKVGFCTFEPKEKRAP
KATYTFQSFIVWEHINKLRLVSPDETRALTEIERNLLYKQAFSKNKMTYY
DIRKLLNLSDDIHFKGLLYDPKSSLKQIENIRFLELDSYHKIRKCIENVY
GKDGIRMFNETDIDTFGYALTIFKDDEDIVAYLQNEYITKNGKRVSNLAN
KVYDKSLIDELLNLSFSKFAHLSMKAIRNILPYMEQGEIYSKACELAGYN
FTGPKKKEKALLLPVIPNIANPVVMRALTQSRKVVNAIIKKYGSPVSIHI
ELARDLSHSFDERKKIQKDQTENRKKNETAIKQLIEYELTKNPTGLDIVK
FKLWSEQGGRCMYSLKPIELERLLEPGYVEVDHILPYSRSLDDSYANKVL
VLTKENREKGNHTPVEYLGLGSERWKKFEKFVLANKQFSKKKQNLLRLR
YEETEEKEFKERNLNDTRYISKFFANPIKEHLKFADGDGGQKVYTINGKI
TAHLRSRWDFNKNREESLDHHAVDAVIVACATQGMIKKITEFYKAREQNK
ESAKKKEPIFPQPWPHFADELKARLSKFPQESIEAFALGNYDRKKLESLR
PVFVSRMPKRSVTGAAHQETLRRCVGIDEQSGKIQTAVKTLKKSDIKLDKD
GHFPMYQKESDPRTYEAIRQRLLEHNNDPKKAFQEPLYKPKKNGEPGPVI
RTVKIIDTKNKVVHLDGSKTVAYNSNIVRTDVFEKDGKYYCVPVYTMDIM
KGTLPNKAIEANKPYSEWKEMTEEYTFQFSLFPNDLVRIVLPREKTIKTS
TNEEIIIKDIFAYYKTIDSATGGLELISHDRNFSLRGVGSKTLKRFEKYQ
VDVLGNIHKVKGEKRVGLAAPTNQKKGKTVDSLQSVSD SEQ ID NO: 380
MRRLGLDLGTNSIGWCLLDLGDDGEPVSIFRTGARIFSDGRDPKSLGSLK
ATRREARLTRRRRDRFIQRQKNLINALVKYGLMPADEIQRQALAYKDPYP SEQ ID NO: 380 (continued)
IRKKALDEAIDPYEMGRAIFHINQRRGFKSNRKSADNEAGVVKQSIADLE
MKLGEAGARTIGEFLADRQATNDTVRARRLSGTNALYEFYPDRYMLEQEF
DTLWAKQAAFNPSLYIEAARERLKEIVFFQRKLKPQEVGRCIFLSDEDRI
SKALPSFQRFRIYQELSNLAWIDHDGVAHRITASLALRDHLFDELEHKKK
LTFKAMRAILRKQGVVDYPVGFNLESDNRDHLIGNLTSCIMRDAKKMIGS
AWDRLDEEEQDSFILMLQDDQKGDDEVRSILTQQYGLSDDVAEDCLDVRL
PDGHGSLSKKAIDRILPVLRDQGLIYYDAVKEAGLGEANLYDPYAALSDK
LDYYGKALAGHVMGASGKFEDSDEKRYGTISNPTVHIALNQVRAVVNELI
RLHGKPDEVVIEIGRDLPMGADGKRELERFQKEGRAKNERARDELKKLGH
IDSRESRQKFQLWEQLAKEPVDRCCPFTGKMMSISDLFSDKVEIEHLLPF
SLTLDDSMANKTVCFRQANRDKGNRAPFDAFGNSPAGYDWQEILGRSQNL
PYAKRWRFLPDAMKRFEADGGFLERQLNDTRYISRYTTEYISTIIPKNKI
WVVTGRLTSLLRGFWGLNSILRGHNTDDGTPAKKSRDDHRHHAIDAIVVG
MTSRGLLQKVSKAARRSEDLDLTRLFEGRIDPWDGFRDEVKKHIDAIIVS
HRPRKKSQGALHNDTAYGIVEHAENGASTVVHRVPITSLGKQSDIEKVRD
PLIKSALLNETAGLSGKSFENAVQKWCADNSIKSLRIVETVSIIPITDKE
GVAYKGYKDGNAYMDIYQDPTSSKWKGEIVSRFDANQKGFIPSWQSQFP
TARLIMRLRINDLLKLQDGEIEEIYRVQRLSGSKILMAPHTEANVDARDR
DKNDTFKLTSKSPGKLQSASARKVHISPTGLIREG SEQ ID NO: 381
MKNILGLDLGLSSSIGWSVIRENSEEQELVAMGSRVVSLTAAELSSFTQGN
GVSINSQRTQKRTQRKGYDRYQLRRTLLRNKLDTLGMLPDDSLSYLPKLQ
LWGLRAKAVTQRIELNELGRVLLHLNQKRGYKSIKSDFSGDKKITDYVKT
VKTRYDELKEMRLTIGELFFRRLTENAFFRCKEQVYPRQAYVEEFDCIMN
CQRKFYPDILTDETIRCIRDEIIIYYQRPLKSCKYLVSRCEFEKRFYLNAA
GKKTEAGPKVSPRTSPLFQVCRLWESINNIVVKDRRNEIVFISAEQRAAL
FDFLNTHEKLKGSDLLKLLGLSKTYGYRLGEQFKTGIQGNKTRVEIERAL
GNYPDKKRLLQFNLQEESSSMVNTETGEIIPMISLSFEQEPLYRLWHVLY
SIDDREQLQSVLRQKFGIDDDEVLERLSAIDLVKAGFGNKSSKAIRRILP
FLQLGMNYAEACEAAGYNHSNNYTKAENEARALLDRLPAIKKNELRQPVV
EKILNQMVNVVNALMEKYGRFDEIRVELARELKQSKEERSNTYKSINKNQ
RENEQIAKRIVEYGVPTRSRIQKYKMWEESKHCCIYCGQPVDVGDFLRGF
DVEVEHIIPKSLYFDDSFANKVCSCRSCNKEKNNRTAYDYMKSKGEKALS
DYVERVNTMYTNNQISKTKWQNLLTPVDKISIDFIDRQLRESQYIARKAK
EILTSICYNVTATSGSVTSFLRHVWGWDTVLHDLNFDRYKKVGLTEVIEV
NHRGSVIRREQIKDWSKRFDHRHHAIDALTIACTKQAYIQRLNNLRAEEG
PDFNKMSLERYIQSQPHFSVAQVREAVDRILVSFRAGKRAVTPGKRYIRK
NRKRISVQSVLIPRGALSEESVYGVIHVWEKDEQGHVIQKQRAVMKYPIT
SINREMLDKEKVVDKRIHRILSGRLAQYNDNPKEAFAKPVYIDKECRIPI
RTVRCFAKPAINTLVPLKKDDKGNPVAWVNPGNNHHVAIYRDEDGKYKER
TVTFWEAVDRCRVGIPAIVTQPDTIWDNILQRNDISENVLESLPDVKWQF
VLSLQQNEMFILGMNEEDYRYAMDQQDYALLNKYLYRVQKLSKSDYSFRY
HTETSVEDKYDGKPNLKLSMQMGKLKRVSIKSLLGLNPHKVHISVLGEIK
EIS SEQ ID NO: 382
MAEKQHRWGLDIGTNSIGWAVIALIEGRPAGLVATGSRIFSDGRNPKDGS
SLAVERRGPRQMRRRRDRYLRRRDRFMQALINVGLMPGDAAARKALVTEN
PYVLRQRGLDQALTLPEFGRALFHLNQRRGFQSNRKTDRATAKESGKVKN
AIAAFRAGMGNARTVGEALARRLEDGPRVRARMVGQGKDEHYELYIAREW
IAQEFDALWASQRPHAEVLADAARDRLRAILLFQRKLLPVPVGKCFLEP
NQPRVAALPSAQRFRLMQELNHLRVMTLADKRERPLSFQERNDLLAQLV
ARPKCGFDMLRKIVFGANKEAYRFTIESERRKELKGCDTAAKLAKVNALG
TRWQALSLDEQDRLVCLLLDGENDAVLADALREHYGLTDAQIDTLLGLSF
EDGHMRLGRSALLRVLDALESGRDEQGLPLSYDKAVVAAGYPAHTADLEN
GERDALPYYGELLWRYTQDAPTAKNDAERFGKIANPTVHIGLNQLRKLV
NALIQRYGKPAQIVVELARNLKAGLEEKERIKKQQTANLERNERIRQKLQ
DAGVPDNRENRLRMRLFEELGQGNGLDTPCIYSGRQISLQRLFSNDVQVD
HILPFSKTLDDSFANKVLAQHDANRYKGNRGPFEAFGANRDGYAWDDIRA
RAAVLPRNKRNRFAETAMQDWLHNETDFLARQLTDTAYLSRVARQYLTAI
CSKDDVYVSPGRLTAMLRAKWGLNRVLDGVMEEQGRPAVKNRDDHRHHAI
DAVVIGATDRAMLQQVATLAARAREQDAERLIGDMPTPWPNFLEDVRAAV
ARCVVSHKPDHGPEGLDHNDTAYGIVAGPDEGRYRVHRVSLFDLKPGD
LSNVRCDAPLQAELEPIFEQDDARAREVALTALAERYRQRKVWLEELMSV
LPIRPRGEDGKTLPDSAPYKAYKGDSNYCYELFINERGRWDGELISTFRA
NQAAYRRFRNDPARFRRYTAGGRPLLMRLCINDYIAVGTAAERTIFRVVK
MSENKITLAEHFEGGTLKQRDADKDDPFKYLTKSPGALRDLGARRIFVDL
IGRVLDPGIKGD SEQ ID NO: 383
MIERILGVDLGISSLGWAIVEYDKDDEAANRIIDCGVRLFTAAETPKKKE
SPNKARREARGIRRVLNRRRVRMNMIKKLFLRAGLIQDVDLDGEGGMFYS
KANRADVWELRHDGLYRLLKGDELARVLIHIAKHRGYKFIGDDEADEESG
KVKKAGVVLRQNFEAAGCRTVGEWLWRERGANGKKRNKHGDYEISIHRDL
LVEEVEAIFVAQQEMRSTIATDALKAAYREIAFFVRPMQRIEKRTLEELLDF
FPEERRAPKSAPTAEKFIAISKFFSTVIIDNEGWEQKIIERKTLEELLDF
AVSREKVEFRHLRKFLDLSDNEIFKGLHYKGKPKTAKKREATLFDPNEPT
ELEFDKVEAEKKAWISLRGAAKLREALGNEFYGRFVALGKHADEATKILT
YYKDEGQKRRELTKLPLEAEMVERLVKIGFSDFLKLSLKAIRDILPAMES
GARYDEAVLMLGVPHKEKSAILPPLNKTDIDILNPTVIRAFAQFRKVANA -continued
LVRKYGAFDRVHFELAREINTKGEIEDIKESQRKNEKERKEAADWIAETS
FQVPLTRKNILKKRLYIQQDGRCAYTGDVIELERLFDEGYCEIDHILPRS
RSADDSFANKVLCLARANQQKTDRTPYEWFGHDAARWNAFETRTSAPSNR
VRTGKGKIDRLLKKNFDENSEMAFKDRNLNDTRYMARAIKTYCEQYWVFK
NSHTKAPVQVRSGKLTSVLRYQWGLESKDRESHTHHAVDAIIIAFSTQGM
VQKLSEYYRFKETHREKERPKLAVPLANFRDAVEEATRIENTETVKEGVE
VKRLLISRPPRARVTGQAHEQTAKPYPRIKQVKNKKKWRLAPIDEEKFES
FKADRVASANQKNFYETSTIPRVDVYHKKGKFHLVPIYLHEMVLNELPNL
SLGTNPEAMDENFFKFSIFKDDLISIQTQGTPKKPAKIIMGYFKNMHGAN
MVLSSINNSPCEGFTCTPVSMDKKHKDKCKLCPEENRIAGRCLQGFLDYW
SQEGLRPPRKEFECDQGVKFALDVKKYQIDPLGYYYEVKQEKRLGTIPQM
RSAKKLVKK SEQ ID NO: 384
MNNSIKSKPEVTIGLDLGVGSVGWAIVDNETNIIHHLGSRLFSQAKTAED
RRSFRGVRRLIRRRKYKLKRFVNLIWKYNSYFGFKNKEDILNNYQEQQKL
HNTVLNLKSEALNAKIDPKALSWILHDYLKNRGHFYEDNRDFNVYPTKEL
AKYFDKYGYYKGIIDSKEDNDNKLEEELTKYKFSNKHWLEEVKKVLSNQT
GLPEKFKEEYESLFSYVRNYSEGPGSINSVSPYGIYHLDEKEGKVVQKYN
NIWDKTIGKCNIFPDEYRAPKNSPIAMIFNEINELSTIRSYSIYLTGWFI
NQEFKKAYLNKLLDDLLIKTNGEKPIDARQFKKLREETIAESIGKETLKDV
ENEEKLEKEDHKWKLKGLKLNTNGKIQYNDLSSLAKFVHKLKQHLKLDFL
LEDQYATLDKINFLQSLFVYLGKHLRYSNRVDSANLKEFSDSNKLFERIL
QKQKDGLFKLFEQTDKDDEKILAQTHSLSTKAMLLAITRMTNLDNDEDNQ
KNNDKGWNFEAIKNFDQKFIDITKKNNNLSLKQNKRYLDDRFINDAILSP
GVKRILREATKVFNAILKQFSEEYDVTKVVIELARELSEEKELENTKNYK
KLIKKNGDKISEGLKALGISEDEIKDILKSPTKSYKFLLWLQQDHIDPYS
LKEIAFDDIFTKTEKFEIDHIIPYSISFDDSSSNKLLVLAESNQAKSNQT
PYEFISSGNAGIKWEDYEAYCRKFKDGDSSLLDSTQRSKKFAKMMKTDTS
SKYDIGFLARNLNDTRYATIVFRDALEDYANNHLVEDKPMPKVCINGSV
TSFLRKNFDDSSYAKKDRDKNIHHAVDASIISIFSNETKTLFNQLTQFAD
YKLFKNTDGSWKKIDPKTGVVTEVTDENWKQIRVRNQVSEIAKVIEKYIQ
DSNIERKARYSRKIENKTNISLFNDTVYSAKKVGYEDQIKRKNLKTLDIH
ESAKENKNSKVKRQFVYRKLVNVSLLNNDKLADLFAEKEDILMYRANPWV
INLAEQIFNEYTENKKIKSQNVFEKYMLDLTKEFPEKFSEFLVKSMLRNK
TAIIYDDKKNIVHRIKRLKMLSSELKENKLSNVIIRSKNQSGTKLSYQDT
INSLALMIMRSIDPTAKKQYIRVPLNTLNLHLGDHDFDLHNMDAYLKKPK
FVKYLKANEIGDEYKPWRVLTSGTLLIHKKDKKLMYISSFQNLNDVIEIK
NLIETEYKENDDSDSKKKKKANRFLMTLSTILNDYILLDAKDNFDILGLS
KNRIDEILNSKLGLDKIVK SEQ ID NO: 385
MGGSEVGTVPVTWRLGVDVGERSIGLAAVSYEEDKPKEILAAVSWIHDGG
VGDERSGASRLALRGMARRARRLRRFRRARLRDLDMLLSELGWTPLPDKN
VSPVDAWLARKRLAEEYVVDETERRRLLGYAVSHMARHRGWRNPWTTIKD
LKNLPQPSDSWERTRESLEARYSVSLEPGTVGQWAGYLLQRAPGIRLNPT
QQSAGRRAELSNATAFETRLRQEDVLWELRCIADVQGLPEDVVSNVIDAV
FCQKRPSVPAERIGRDPLDPSQLRASRACLEFQEYRIVAAVANLRIRDGS
GSRPLSLEERNAVIEALLAQTERSLTWSDIALEILKLPNESDLTSVPEED
GPSSLAYSQFAPFDETSARIAEFIAKNRRKIPTFAQWWQEQDRTSRSDLV
AALADNSIAGEEEQELLVHLPDAELEALEGLALPSGRVAYSRLTLSGLTR
VMRDDGVDVHNARKTCFGVDDNWRPPLPALHEATGHPVVDRNLAILRKFL
SSATMRWGPPQSIVVELARGASESRERQAEEEAARRAHRKANDRIRAELR
ASGLSDPSPADLVRARLLELYDCHCMYCGAPISWENSELDHIVPRTDGGS
NRHENLAITCGACNKEKGRRPFASWAETSNRVQLRDVIDRVQKLKYSGNM
YWTRDEFSRYKKSVVARLKRRTSDPEVIQSIESTGYAAVALRDRLLSYGE
KNGVAQVAVFRGGVTAEARRWLDISIERLFSRVAIFAQSTSTKRLDRRHH
AVDAVVLTTLTPGVAKTLADARSRRVSAEFWRRPSDVNRHSTEEPQSPAY
RQWKESCSGLGDLLISTAARDSIAVAAPLRLRPTGALHEETLRAFSEHTV
GAAWKGAELRRIVEPEVYAAFLALTDPGGRFLKVSPSEDVLPADENRHIV
LSDRVLGPRDRVKLFPDDRGSIRVRGGAAYIASFHHARVFRWGSSHSPSF
ALLRVSLADLAVAGLLRDGVDVFTAELPPWTPAWRYASIALVKAVESGDA
KQVGWLVPGDELDFGPEGVTTAAGDLSMFLKYFPERHWVVTGFEDDKRIN
LKPAFLSAEQAEVLRTERSDRPDTLTEAGEILAQFFPRCWRATVAKVLCH
PGLTVIRRTALGQPRWRRGHLPYSWRPWSADPWSGGTP SEQ ID NO: 386
MHNKKNITIGFDLGIASIGWAIIDSTTSKILDWGTRTFEERKTANERRAF
RSTRRNIRRKAYRNQRFINLILKYKDLFELKNISDIQRANKKDTENYEKI
ISFFTEIYKKCAAKHSNILEVKVKALDSKIEKLDLIWILHDYLENRGFFY
DLEEENVADKYEGIEHPSILLYDFFKKNGFFKSNSSIPKDLGGYSFSNLQ
WVNEIKKLFEVQEINPEFSEKFLNLFTSVRDYAKGPGSEHKSASEYGIFQK
DEKGKVFKKYDNIWDKTIGKCSFFVEENRSPVNYPSYEIFNLLNQLINLS
TDLKTTNKKIWQLSSNDRNELLDELLKVKEKAKIISISLKKNEIKKIILK
DFGFEKSDIDDQDTIEGRKIIKEEPTTKLEVTKHLLATIYSHSSDSNWIN
INNILEFLPYLDAICIILDREKSRGQDEVLKKLTEKNIFEVLKIDREKQL
DFVKSIFSNTKFNFKKIGNFSLKAIREFLPKMFEQNKNSEYLKWKDEEIR
RKWEEQKSKLGKTDKKTKYLNPRIFQDEIISPGTKNTFEQAVLVLNQIIK
KYSKENIIDAIIIESPREKNDKKTIEEIKKRNKKGKGKTLEKLFQILNLE
NKGYKLSDLETKPAKLLDRLRFYHQQDGIDLYTLDKINIDQLINGSQKYE
IEHIIPYSMSYDNSQANKILTEKAENLKKGKLIASEYIKRNGDEFYNKYY -continued
EKAKELFINKYKKNKKLDSYVDLDEDSAKNRFRFLTLQDYDEFQVEFLAR
NLNDTRYSTKLFYHALVEHFENNEFFTYIDENSSKHKVKISTIKGHVTKY
FRAKPVQKNNGPNENLNNNKPEKIEKNRENNEHHAVDAAIVAIIGNKNPQ
IANLLTLADNKTDKKFLLHDENYKENIETGELVKIPKFEVDKLAKVEDLK
KIIQEKYEEAKKHTAIKFSRKTRTILNGGLSDETLYGFKYDEKEDKYFKI
IKKKLVTSKNEELKKYFENPFGKKADGKSEYTVLMAQSHLSEFNKLKEIF
EKYNGFSNKTGNAFVEYMNDLALKEPTLKAEIESAKSVEKLLYYNFKPSD
QFTYHDNINNKSFKRFYKNIRIIEYKSIPIKFKILSKHDGGKSFKDTLFS
LYSLVYKVYENGKESYKSIPVTSQMRNFGIDEFDPFLDENLYNKEKLDIYK
SDFAKPIPVNCKPVFVLKKGSILKKKSLDIDDFKETKETEEGNYYFISTI
SKRFNRDTAYGLKPLKLSVVKPVAEPSTNPIFKEYIPIHLDELGNEYPVK
IKEHTDDEKLMCTIK Nucleic Acids Encoding Cas9 Molecules Nucleic acids encoding the Cas9 molecules or Cas9 polypeptides, e.g., an eaCas9 molecule or eaCas9 polypeptide, are provided herein.

Exemplary nucleic acids encoding Cas9 molecules or Cas9 polypeptides are described in Cong et al., SCIENCE 2013, 399(6121):819-823; Wang et al., CELL 2013, 153(4):910-918; Mali et al., SCIENCE 2013, 399(6121):823-826; Jinek et al., SCIENCE 2012, 337(6096):816-821. Another exemplary nucleic acid encoding a Cas9 molecule or Cas9 polypeptide is shown in black in FIG. 8.

In an embodiment, a nucleic acid encoding a Cas9 molecule or Cas9 polypeptide can be a synthetic nucleic acid sequence. For example, the synthetic nucleic acid molecule can be chemically modified, e.g., as described in Section VIII. In an embodiment, the Cas9 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

Provided below is an exemplary codon optimized nucleic acid sequence encoding a Cas9 molecule of S. pyogenes.

(SEQ ID NO: 22)
ATGGATAAAA AGTACAGCAT CGGGCTGGAC ATCGGTACAA

ACTCAGTGGG GTGGGCCGTG ATTACGGACG AGTACAAGGT

ACCCTCCAAA AAATTTAAAG TGCTGGGTAA CACGGACAGA

CACTCTATAA AGAAAAATCT TATTGGAGCC TTGCTGTTCG

ACTCAGGCGA GACAGCCGAA GCCACAAGGT TGAAGCGGAC

CGCCAGGAGG CGGTATACCA GGAGAAAGAA CCGCATATGC

TACCTGCAAG AAATCTTCAG TAACGAGATG GCAAAGGTTG

ACGATAGCTT TTTCCATCGC CTGGAAGAAT CCTTTCTTGT

TGAGGAAGAC AAGAAGCACG AACGGCACCC CATCTTTGGC

AATATTGTCG ACGAAGTGGC ATATCACGAA AAGTACCCGA

CTATCTACCA CCTCAGGAAG AAGCTGGTGG ACTCTACCGA

TAAGGCGGAC CTCAGACTTA TTTATTTGGC ACTCGCCCAC

```
ATGATTAAAT TTAGAGGACA TTTCTTGATC GAGGGCGACC
TGAACCCGGA CAACAGTGAC GTCGATAAGC TGTTCATCCA
ACTTGTGCAG ACCTACAATC AACTGTTCGA AGAAAACCCT
ATAAATGCTT CAGGAGTCGA CGCTAAAGCA ATCCTGTCCG
CGCGCCTCTC AAAATCTAGA AGACTTGAGA ATCTGATTGC
TCAGTTGCCC GGGGAAAAGA AAAATGGATT GTTTGGCAAC
CTGATCGCCC TCAGTCTCGG ACTGACCCCA AATTTCAAAA
GTAACTTCGA CCTGGCCGAA GACGCTAAGC TCCAGCTGTC
CAAGGACACA TACGATGACG ACCTCGACAA TCTGCTGGCC
CAGATTGGGG ATCAGTACGC CGATCTCTTT TTGGCAGCAA
AGAACCTGTC CGACGCCATC CTGTTGAGCG ATATCTTGAG
AGTGAACACC GAAATTACTA AAGCACCCCT TAGCGCATCT
ATGATCAAGC GGTACGACGA GCATCATCAG GATCTGACCC
TGCTGAAGGC TCTTGTGAGG CAACAGCTCC CCGAAAAATA
CAAGGAAATC TTCTTTGACC AGAGCAAAAA CGGCTACGCT
GGCTATATAG ATGGTGGGGC CAGTCAGGAG GAATTCTATA
AATTCATCAA GCCCATTCTC GAGAAAATGG ACGGCACAGA
GGAGTTGCTG GTCAAACTTA ACAGGGAGGA CCTGCTGCGG
AAGCAGCGGA CCTTTGACAA CGGGTCTATC CCCCACCAGA
TTCATCTGGG CGAACTGCAC GCAATCCTGA GGAGGCAGGA
GGATTTTTAT CCTTTTCTTA AAGATAACCG CGAGAAAATA
GAAAAGATTC TTACATTCAG GATCCCGTAC TACGTGGGAC
CTCTCGCCCG GGGCAATTCA CGGTTTGCCT GGATGACAAG
GAAGTCAGAG GAGACTATTA CACCTTGGAA CTTCGAAGAA
GTGGTGGACA AGGGTGCATC TGCCCAGTGT TTCATCGAGC
GGATGACAAA TTTTGACAAG AACCTCCCTA ATGAGAAGGT
GCTGCCCAAA CATTCTCTGC TCTACGAGTA CTTTACCGTC
TACAATGAAC TGACTAAAGT CAAGTACGTC ACCGAGGGAA
TGAGGAAGCC GGCATTCCTT AGTGGAGAAC AGAAGAAGGC
GATTGTAGAC CTGTTGTTCA AGACCAACAG GAAGGTGACT
GTGAAGCAAC TTAAAGAAGA CTACTTTAAG AAGATCGAAT
GTTTTGACAG TGTGGAAATT TCAGGGGTTG AAGACCGCTT
CAATGCGTCA TTGGGGACTT ACCATGATCT TCTCAAGATC
ATAAAGGACA AAGACTTCCT GGACAACGAA GAAAATGAGG
ATATTCTCGA AGACATCGTC CTCACCCTGA CCCTGTTCGA
AGACAGGGAA ATGATAGAAG AGCGCTTGAA AACCTATGCC
CACCTCTTCG ACGATAAAGT TATGAAGCAG CTGAAGCGCA
GGAGATACAC AGGATGGGGA AGATTGTCAA GGAAGCTGAT
CAATGGAATT AGGGATAAAC AGAGTGGCAA GACCATACTG
GATTTCCTCA AATCTGATGG CTTCGCCAAT AGGAACTTCA
TGCAACTGAT TCACGATGAC TCTCTTACCT TCAAGGAGGA

CATTCAAAAG GCTCAGGTGA GCGGGCAGGG AGACTCCCTT
CATGAACACA TCGCGAATTT GGCAGGTTCC CCCGCTATTA
AAAAGGGCAT CCTTCAAACT GTCAAGGTGG TGGATGAATT
GGTCAAGGTA ATGGGCAGAC ATAAGCCAGA AAATATTGTG
ATCGAGATGG CCCGCGAAAA CCAGACCACA CAGAAGGGCC
AGAAAAATAG TAGAGAGCGG ATGAAGAGGA TCGAGGAGGG
CATCAAAGAG CTGGGATCTC AGATTCTCAA AGAACACCCC
GTAGAAAACA CACAGCTGCA GAACGAAAAA TTGTACTTGT
ACTATCTGCA GAACGGCAGA GACATGTACG TCGACCAAGA
ACTTGATATT AATAGACTGT CCGACTATGA CGTAGACCAT
ATCGTGCCCC AGTCCTTCCT GAAGGACGAC TCCATTGATA
ACAAAGTCTT GACAAGAAGC GACAAGAACA GGGGTAAAAG
TGATAATGTG CCTAGCGAGG AGGTGGTGAA AAAAATGAAG
AACTACTGGC GACAGCTGCT TAATGCAAAG CTCATTACAC
AACGGAAGTT CGATAATCTG ACGAAAGCAG AGAGAGGTGG
CTTGTCTGAG TTGGACAAGG CAGGGTTTAT TAAGCGGCAG
CTGGTGGAAA CTAGGCAGAT CACAAAGCAC GTGGCGCAGA
TTTTGGACAG CCGGATGAAC ACAAAATACG ACGAAAATGA
TAAACTGATA CGAGAGGTCA AAGTTATCAC GCTGAAAAGC
AAGCTGGTGT CCGATTTTCG GAAAGACTTC CAGTTCTACA
AAGTTCGCGA GATTAATAAC TACCATCATG CTCACGATGC
GTACCTGAAC GCTGTTGTCG GGACCGCCTT GATAAAGAAG
TACCCAAAGC TGGAATCCGA GTTCGTATAC GGGGATTACA
AAGTGTACGA TGTGAGGAAA ATGATAGCCA AGTCCGAGCA
GGAGATTGGA AAGGCCACAG CTAAGTACTT CTTTTATTCT
AACATCATGA ATTTTTTTAA GACGGAAATT ACCCTGGCCA
ACGGAGAGAT CAGAAAGCGG CCCCTTATAG AGACAAATGG
TGAAACAGGT GAAATCGTCT GGGATAAGGG CAGGGATTTC
GCTACTGTGA GGAAGGTGCT GAGTATGCCA CAGGTAAATA
TCGTGAAAAA AACCGAAGTA CAGACCGGAG GATTTTCCAA
GGAAAGCATT TTGCCTAAAA GAAACTCAGA CAAGCTCATC
GCCCGCAAGA AGATTGGGA CCCTAAGAAA TACGGGGGAT
TTGACTCACC CACCGTAGCC TATTCTGTGC TGGTGGTAGC
TAAGGTGGAA AAAGGAAAGT CTAAGAAGCT GAAGTCCGTG
AAGGAACTCT GGGAATCAC TATCATGGAA AGATCATCCT
TTGAAAAGAA CCCTATCGAT TTCCTGGAGG CTAAGGGTTA
CAAGGAGGTC AAGAAAGACC TCATCATTAA ACTGCCAAAA
TACTCTCTCT TCGAGCTGGA AAATGGCAGG AAGAGAATGT
TGGCCAGCGC CGGAGAGCTG CAAAAGGGAA ACGAGCTTGC
TCTGCCCTCC AAATATGTTA ATTTTCTCTA TCTCGCTTCC
```

-continued
```
CACTATGAAA AGCTGAAAGG GTCTCCCGAA GATAACGAGC

AGAAGCAGCT GTTCGTCGAA CAGCACAAGC ACTATCTGGA

TGAAATAATC GAACAAATAA GCGAGTTCAG CAAAAGGGTT

ATCCTGGCGG ATGCTAATTT GGACAAAGTA CTGTCTGCTT

ATAACAAGCA CCGGGATAAG CCTATTAGGG AACAAGCCGA

GAATATAATT CACCTCTTTA CACTCACGAA TCTCGGAGCC

CCCGCCGCCT TCAAATACTT TGATACGACT ATCGACCGGA

AACGGTATAC CAGTACCAAA GAGGTCCTCG ATGCCACCCT

CATCCACCAG TCAATTACTG GCCTGTACGA AACACGGATC

GACCTCTCTC AACTGGGCGG CGACTAG
```

Provided below is the corresponding amino acid sequence of a S. pyogenes Cas9 molecule.

```
                                            (SEQ ID NO: 23)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD*
```

Provided below is an exemplary codon optimized nucleic acid sequence encoding a Cas9 molecule of N. meningitidis.

```
                                            (SEQ ID NO: 24)
ATGGCCGCCTTCAAGCCCAACCCCATCAACTACATCCTGGGCCTGGACAT

CGGCATCGCCAGCGTGGGCTGGGCCATGGTGGAGATCGACGAGGACGAGA

ACCCCATCTGCCTGATCGACCTGGGTGTGCGCGTGTTCGAGCGCGCTGAG

GTGCCCAAGACTGGTGACAGTCTGGCTATGGCTCGCCGGCTTGCTCGCTC

TGTTCGGCGCCTTACTCGCCGGCGCGCTCACCGCCTTCTGCGCGCTCGCC

GCCTGCTGAAGCGCGAGGGTGTGCTGCAGGCTGCCGACTTCGACGAGAAC

GGCCTGATCAAGAGCCTGCCCAACACTCCTTGGCAGCTGCGCGCTGCCGC

TCTGGACCGCAAGCTGACTCCTCTGGAGTGGAGCGCCGTGCTGCTGCACC

TGATCAAGCACCGCGGCTACCTGAGCCAGCGCAAGAACGAGGGCGAGACC

GCCGACAAGGAGCTGGGTGCTCTGCTGAAGGGCGTGGCCGACAACGCCCA

CGCCCTGCAGACTGGTGACTTCCGCACTCCTGCTGAGCTGGCCCTGAACA

AGTTCGAGAAGGAGAGCGGCCACATCCGCAACCAGCGCGGCGACTACAGC

CACACCTTCAGCCGCAAGGACCTGCAGGCCGAGCTGATCCTGCTGTTCGA

GAAGCAGAAGGAGTTCGGCAACCCCCACGTGAGCGGCGGCCTGAAGGAGG

GCATCGAGACCCTGCTGATGACCCAGCGCCCCGCCCTGAGCGGCGACGCC

GTGCAGAAGATGCTGGGCCACTGCACCTTCGAGCCAGCCGAGCCCAAGGC

CGCCAAGAACACCTACACCGCCGAGCGCTTCATCTGGCTGACCAAGCTGA

ACAACCTGCGCATCCTGGAGCAGGGCAGCGAGCGCCCCCTGACCGACACC

GAGCGCGCCACCCTGATGGACGAGCCCTACCGCAAGAGCAAGCTGACCTA

CGCCCAGGCCCGCAAGCTGCTGGGTCTGGAGGACACCGCCTTCTTCAAGG

GCCTGCGCTACGGCAAGGACAACGCCGAGGCCAGCACCCTGATGGAGATG

AAGGCCTACCACGCCATCAGCCGCGCCCTGGAGAAGGAGGGCCTGAAGGA

CAAGAAGAGTCCTCTGAACCTGAGCCCCGAGCTGCAGGACGAGATCGGCA

CCGCCTTCAGCCTGTTCAAGACCGACGAGGACATCACCGGCCGCCTGAAG

GACCGCATCCAGCCCGAGATCCTGGAGGCCCTGCTGAAGCACATCAGCTT

CGACAAGTTCGTGCAGATCAGCCTGAAGGCCCTGCGCCGCATCGTGCCCC

TGATGGAGCAGGGCAAGCGCTACGACGAGGCCTGCGCCGAGATCTACGGC

GACCACTACGGCAAGAAGAACACCGAGGAGAAGATCTACCTGCCTCCTAT

CCCCGCCGACGAGATCCGCAACCCCGTGGTGCTGCGCGCCCTGAGCCAGG

CCCGCAAGGTGATCAACGGCGTGGTGCGCCGCTACGGCAGCCCCGCCCGC

ATCCACATCGAGACCGCCCGCGAGGTGGGCAAGAGCTTCAAGGACCGCAA

GGAGATCGAGAAGCGCCAGGAGGAGAACCGCAAGGACCGCGAGAAGGCCG

CCGCCAAGTTCCGCGAGTACTTCCCCAACTTCGTGGGCGAGCCCAAGAGC

AAGGACATCCTGAAGCTGCGCCTGTACGAGCAGCAGCACGGCAAGTGCCT

GTACAGCGGCAAGGAGATCAACCTGGGCCGCCTGAACGAGAAGGGCTACG

TGGAGATCGACCACGCCCTGCCCTTCAGCCGCACCTGGGACGACAGCTTC

AACAACAAGGTGCTGGTGCTGGGCAGCGAGAACCAGAACAAGGGCAACCA

GACCCCCTACGAGTACTTCAACGGCAAGGACAACAGCCGCGAGTGGCAGG
```

-continued
```
AGTTCAAGGCCCGCGTGGAGACCAGCCGCTTCCCCCGCAGCAAGAAGCAG
CGCATCCTGCTGCAGAAGTTCGACGAGGACGGCTTCAAGGAGCGCAACCT
GAACGACACCCGCTACGTGAACCGCTTCCTGTGCCAGTTCGTGGCCGACC
GCATGCGCCTGACCGGCAAGGGCAAGAAGCGCGTGTTCGCCAGCAACGGC
CAGATCACCAACCTGCTGCGCGGCTTCTGGGGCCTGCGCAAGGTGCGCGC
CGAGAACGACCGCCACCACGCCCTGGACGCCGTGGTGGTGGCCTGCAGCA
CCGTGGCCATGCAGCAGAAGATCACCCGCTTCGTGCGCTACAAGGAGATG
AACGCCTTCGACGGTAAAACCATCGACAAGGAGACCGGCGAGGTGCTGCA
CCAGAAGACCCACTTCCCCCAGCCCTGGGAGTTCTTCGCCCAGGAGGTGA
TGATCCGCGTGTTCGGCAAGCCCGACGGCAAGCCCGAGTTCGAGGAGGCC
GACACCCCCGAGAAGCTGCGCACCCTGCTGGCCGAGAAGCTGAGCAGCCG
CCCTGAGGCCGTGCACGAGTACGTGACTCCTCTGTTCGTGAGCCGCGCCC
CCAACCGCAAGATGAGCGGTCAGGGTCACATGGAGACCGTGAAGAGCGCC
AAGCGCCTGGACGAGGGCGTGAGCGTGCTGCGCGTGCCCCTGACCCAGCT
GAAGCTGAAGGACCTGGAGAAGATGGTGAACCGCGAGCGCGAGCCCAAGC
TGTACGAGGCCCTGAAGGCCCGCCTGGAGGCCCACAAGGACGACCCCGCC
AAGGCCTTCGCCGAGCCCTTCTACAAGTACGACAAGGCCGGCAACCGCAC
CCAGCAGGTGAAGGCCGTGCGCGTGGAGCAGGTGCAGAAGACCGGCGTGT
GGGTGCGCAACCACAACGGCATCGCCGACAACGCCACCATGGTGCGCGTG
GACGTGTTCGAGAAGGGCGACAAGTACTACCTGGTGCCCATCTACAGCTG
GCAGGTGGCCAAGGGCATCCTGCCCGACCGCGCCGTGGTGCAGGGCAAGG
ACGAGGAGGACTGGCAGCTGATCGACGACAGCTTCAACTTCAAGTTCAGC
CTGCACCCCAACGACCTGGTGGAGGTGATCACCAAGAAGGCCCGCATGTT
CGGCTACTTCGCCAGCTGCCACCGCGGCACCGGCAACATCAACATCCGCA
TCCACGACCTGGACCACAAGATCGGCAAGAACGGCATCCTGGAGGGCATC
GGCGTGAAGACCGCCCTGAGCTTCCAGAAGTACCAGATCGACGAGCTGGG
CAAGGAGATCCGCCCCTGCCGCCTGAAGAAGCGCCCTCCTGTGCGCTAA
```
Provided below is the corresponding amino acid sequence of a *N. meningitidis* Cas9 molecule.

```
                                      (SEQ ID NO: 25)
MAAFKPNPINYILGLDIGIASVGWAMVEIDEDENPICLIDLGVRVFERAE
VPKTGDSLAMARRLARSVRRLTRRRAHRLLRARRLLKREGVLQAADFDEN
GLIKSLPNTPWQLRAAALDRKLTPLEWSAVLLHLIKHRGYLSQRKNEGET
ADKELGALLKGVADNAHALQTGDFRTPAELALNKFEKESGHIRNQRGDYS
HTFSRKDLQAELILLFEKQKEFGNPHVSGGLKEGIETLLMTQRPALSGDA
VQKMLGHCTFEPAEPKAAKNTYTAERFIWLTKLNNLRILEQGSERPLTDT
ERATLMDEPYRKSKLTYAQARKLLGLEDTAFFKGLRYGKDNAEASTLMEM
KAYHAISRALEKEGLKDKKSPLNLSPELQDEIGTAFSLFKTDEDITGRLK
DRIQPEILEALLKHISFDKFVQISLKALRRIVPLMEQGKRYDEACAEIYG
DHYGKKNTEEKIYLPPIPADEIRNPVVLRALSQARKVINGVVRRYGSPAR
IHIETAREVGKSFKDRKEIEKRQEENRKDREKAAAKFREYFPNFVGEPKS
KDILKLRLYEQQHGKCLYSGKEINLGRLNEKGYVEIDHALPFSRTWDDSF
NNKVLVLGSENQNKGNQTPYEYFNGKDNSREWQEFKARVETSRFPRSKKQ
RILLQKFDEDGFKERNLNDTRYVNRFLCQFVADRMRLTGKGKKRVFASNG
QITNLLRGFWGLRKVRAENDRHHALDAVVVACSTVAMQQKITRFVRYKEM
NAFDGKTIDKETGEVLHQKTHFPQPWEFFAQEVMIRVFGKPDGKPEFEEA
DTPEKLRTLLAEKLSSRPEAVHEYVTPLFVSRAPNRKMSGQGHMETVKSA
KRLDEGVSVLRVPLTQLKLKDLEKMVNREREPKLYEALKARLEAHKDDPA
KAFAEPFYKYDKAGNRTQQVKAVRVEQVQKTGVWVRNHNGIADNATMVRV
DVFEKGDKYYLVPIYSWQVAKGILPDRAVVQGKDEEDWQLIDDSFNFKFS
LHPNDLVEVITKKARMFGYFASCHRGTGNINIRIHDLDHKIGKNGILEGI
GVKTALSFQKYQIDELGKEIRPCRLKKRPPVR*
```

Provided below is an amino acid sequence of a *S. aureus* Cas9 molecule.

```
                                      (SEQ ID NO: 26)
MKRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLMGHCTYFPEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIIRTTGKENAKYLIEKIKLHDMQEGKCLYSLEAIPLEDLLNNP
FNYEVDHIIPRSVSFDNSFNNKVLVKQEENSKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIFKEWKKLDKAKKVMENQMFEEKQAESMPEIETEQEY
KEIFITPHQIKHIKDFKDYKYSHRVDKKPNRELINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
RNKVVKLSLKPYRFDVYLDNGVYKFVTVKNLDVIKKENYYEVNSKCYEEA
KKLKKISNQAEFIASFYNNDLIKINGELYRVIGVNNDLLNRIEVNMIDIT
YREYLENMNDKRPPRIIKTIASKTQSIKKYSTDILGNLYEVKSKKHPQII
KKG*
```

Provided below is an exemplary codon optimized nucleic acid sequence encoding a Cas9 molecule of *S. aureus* Cas9.

```
                                      (SEQ ID NO: 39)
ATGAAAAGGAACTACATTCTGGGGCTGGACATCGGGATTACAAGCGTGG
GGTATGGGATTATTGACTATGAAACAAGGGACGTGATCGACGCAGGCGT
```

```
CAGACTGTTCAAGGAGGCCAACGTGGAAAACAATGAGGGACGGAGAAGC
AAGAGGGGAGCCAGGCGCCTGAAACGACGGAGAAGGCACAGAATCCAGA
GGGTGAAGAAACTGCTGTTCGATTACAACCTGCTGACCGACCATTCTGA
GCTGAGTGGAATTAATCCTTATGAAGCCAGGGTGAAAGGCCTGAGTCAG
AAGCTGTCAGAGGAAGAGTTTTCCGCAGCTCTGCTGCACCTGGCTAAGC
GCCGAGGAGTGCATAACGTCAATGAGGTGGAAGAGGACACCGGCAACGA
GCTGTCTACAAAGGAACAGATCTCACGCAATAGCAAAGCTCTGGAAGAG
AAGTATGTCGCAGAGCTGCAGCTGGAACGGCTGAAGAAAGATGGCGAGG
TGAGAGGGTCAATTAATAGGTTCAAGACAAGCGACTACGTCAAAGAAGC
CAAGCAGCTGCTGAAAGTGCAGAAGGCTTACCACCAGCTGGATCAGAGC
TTCATCGATACTTATATCGACCTGCTGGAGACTCGGAGAACCTACTATG
AGGGACCAGGAGAAGGGAGCCCCTTCGGATGGAAAGACATCAAGGAATG
GTACGAGATGCTGATGGGACATTGCACCTATTTTCCAGAAGAGCTGAGA
AGCGTCAAGTACGCTTATAACGCAGATCTGTACAACGCCCTGAATGACC
TGAACAACCTGGTCATCACCAGGGATGAAAACGAGAAACTGGAATACTA
TGAGAAGTTCCAGATCATCGAAAACGTGTTTAAGCAGAAGAAAAAGCCT
ACACTGAAACAGATTGCTAAGGAGATCCTGGTCAACGAAGAGGACATCA
AGGGCTACCGGGTGACAAGCACTGGAAAACCAGAGTTCACCAATCTGAA
AGTGTATCACGATATTAAGGACATCACAGCACGGAAAGAAATCATTGAG
AACGCCGAACTGCTGGATCAGATTGCTAAGATCCTGACTATCTACCAGA
GCTCCGAGGACATCCAGGAAGAGCTGACTAACCTGAACAGCGAGCTGAC
CCAGGAAGAGATCGAACAGATTAGTAATCTGAAGGGGTACACCGGAACA
CACAACCTGTCCCTGAAAGCTATCAATCTGATTCTGGATGAGCTGTGGC
ATACAAACGACAATCAGATTGCAATCTTTAACCGGCTGAAGCTGGTCCC
AAAAAAGGTGGACCTGAGTCAGCAGAAAGAGATCCCAACCACACTGGTG
GACGATTTCATTCTGTCACCCGTGGTCAAGCGGAGCTTCATCCAGAGCA
TCAAAGTGATCAACGCCATCATCAAGAAGTACGGCCTGCCCAATGATAT
CATTATCGAGCTGGCTAGGGAGAAGAACAGCAAGGACGCACAGAAGATG
ATCAATGAGATGCAGAAACGAAACCGGCAGACCAATGAACGCATTGAAG
AGATTATCCGAACTACCGGGAAGAGAACGCAAAGTACCTGATTGAAAA
AATCAAGCTGCACGATATGCAGGAGGGAAAGTGTCTGTATTCTCTGGAG
GCCATCCCCCTGGAGGACCTGCTGAACAATCCATTCAACTACGAGGTCG
ATCATATTATCCCCAGAAGCGTGTCCTTCGACAATTCCTTTAACAACAA
GGTGCTGGTCAAGCAGGAAGAGAACTCTAAAAAGGGCAATAGGACTCCT
TTCCAGTACCTGTCTAGTTCAGATTCCAAGATCTCTTACGAAACCTTTA
AAAAGCACATTCTGAATCTGGCCAAAGGAAAGGGCCGCATCAGCAAGAC
CAAAAAGGAGTACCTGCTGGAAGAGCGGGACATCAACAGATTCTCCGTC
CAGAAGGATTTTATTAACCGGAATCTGGTGGACACAAGATACGCTACTC
GCGGCCTGATGAATCTGCTGCGATCCTATTTCCGGGTGAACAATCTGGA
TGTGAAAGTCAAGTCCATCAACGGCGGGTTCACATCTTTTCTGAGGCGC
AAATGGAAGTTTAAAAAGGAGCGCAACAAAGGGTACAAGCACCATGCCG
AAGATGCTCTGATTATCGCAAATGCCGACTTCATCTTTAAGGAGTGGAA
AAAGCTGGACAAAGCCAAGAAAGTGATGGAGAACCAGATGTTCGAAGAG
AAGCAGGCCGAATCTATGCCCGAAATCGAGACAGAACAGGAGTACAAGG
AGATTTTCATCACTCCTCACCAGATCAAGCATATCAAGGATTTCAAGGA
CTACAAGTACTCTCACCGGGTGGATAAAAAGCCCAACAGAGAGCTGATC
AATGACACCCTGTATAGTACAAGAAAAGACGATAAGGGGAATACCCTGA
TTGTGAACAATCTGAACGGACTGTACGACAAAGATAATGACAAGCTGAA
AAAGCTGATCAACAAAAGTCCCGAGAAGCTGCTGATGTACCACCATGAT
CCTCAGACATATCAGAAACTGAAGCTGATTATGGAGCAGTACGGCGACG
AGAAGAACCCACTGTATAAGTACTATGAAGAGACTGGGAACTACCTGAC
CAAGTATAGCAAAAAGGATAATGGCCCCGTGATCAAGAAGATCAAGTAC
TATGGGAACAAGCTGAATGCCCATCTGGACATCACAGACGATTACCCTA
ACAGTCGCAACAAGGTGGTCAAGCTGTCACTGAAGCCATACAGATTCGA
TGTCTATCTGGACAACGGCGTGTATAAATTTGTGACTGTCAAGAATCTG
GATGTCATCAAAAAGGAGAACTACTATGAAGTGAATAGCAAGTGCTACG
AAGAGGCTAAAAAGCTGAAAAAGATTAGCAACCAGGCAGAGTTCATCGC
CTCCTTTTACAACAACGACCTGATTAAGATCAATGGCGAACTGTATAGG
GTCATCGGGGTGAACAATGATCTGCTGAACCGCATTGAAGTGAATATGA
TTGACATCACTTACCGAGAGTATCTGGAAAACATGAATGATAAGCGCCC
CCCTCGAATTATCAAAACAATTGCCTCTAAGACTCAGAGTATCAAAAAG
TACTCAACCGACATTCTGGGAAACCTGTATGAGGTGAAGAGCAAAAAGC
ACCCTCAGATTATCAAAAAGGGC
```

If any of the above Cas9 sequences are fused with a peptide or polypeptide at the C-terminus, it is understood that the stop codon will be removed.

Other Cas Molecules and Cas Polypeptides

Various types of Cas molecules or Cas polypeptides can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al., PLoS COMPUTATIONAL BIOLOGY 2005, 1(6): e60 and Makarova et al., NATURE REVIEW MICROBIOLOGY 2011, 9:467-477, the contents of both references are incorporated herein by reference in their entirety. Exemplary Cas molecules (and Cas systems) are also shown in Table 16.

TABLE 16

Cas Systems

| Gene name[‡] | System type or subtype | Name from Haft et al.[§] | Structure of encoded protein (PDB accessions)[¶] | Families (and superfamily) of encoded protein[#**] | Representatives |
|---|---|---|---|---|---|
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |
| cas3' | Type I[‡‡] | cas3 | NA | COG1203 | APE1232 and ygcB |
| cas3" | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A Subtype III-B | cas6 and cmx6 | 3I4H | COG1583 and COG5551 (RAMP) | PF1131 and slr7014 |
| cas6e | Subtype I-E | cse3 | 1WJ9 | (RAMP) | ygcH |
| cas6f | Subtype I-F | csy4 | 2XLJ | (RAMP) | y1727 |
| cas7 | Subtype I-A<br>Subtype I-B<br>Subtype I-C<br>Subtype I-E | csa2, csd2, cse4, csh2, csp1 and cst2 | NA | COG1857 and COG3649 (RAMP) | devR and ygcJ |
| cas8a1 | Subtype I-A[‡‡] | cmx1, cst1, csx8, csx13 and CXXC-CXXC | NA | BH0338-like | LA3191[§§] and PG2018[§§] |
| cas8a2 | Subtype I-A[‡‡] | csa4 and csx9 | NA | PH0918 | AF0070, AF1873, MJ0385, PF0637, PH0918 and SSO1401 |
| cas8b | Subtype I-B[‡‡] | csh1 and TM1802 | NA | BH0338-like | MTH1090 and TM1802 |
| cas8c | Subtype I-C[‡‡] | csd1 and csp2 | NA | BH0338-like | BH0338 |
| cas9 | Type II[‡‡] | csn1 and csx12 | NA | COG3513 | FTN_0757 and SPy1046 |
| cas10 | Type III[‡‡] | cmr2, csm1 and csx11 | NA | COG1353 | MTH326, Rv2823c[§§] and TM1794[§§] |
| cas10d | Subtype I-D[‡‡] | csc3 | NA | COG1353 | slr7011 |
| csy1 | Subtype I-F[‡‡] | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E[‡‡] | cse1 | NA | YgcL-like | ygcL |
| cse2 | Subtype I-E | cse2 | 2ZCA | YgcK-like | ygcK |
| csc1 | Subtype I-D | csc1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn2 | NA | SPy1049-like | SPy1049 |
| csm2 | Subtype III-A[‡‡] | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |

TABLE 16-continued

Cas Systems

| Gene name‡ | System type or subtype | Name from Haft et al.§ | Structure of encoded protein (PDB accessions)¶ | Families (and superfamily) of encoded protein#** | Representatives |
|---|---|---|---|---|---|
| cmr1 | Subtype III-B | cmr1 | NA | COG1367 (RAMP) | PF1130 |
| cmr3 | Subtype III-B | cmr3 | NA | COG1769 (RAMP) | PF1128 |
| cmr4 | Subtype III-B | cmr4 | NA | COG1336 (RAMP) | PF1126 |
| cmr5 | Subtype III-B‡‡ | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |
| csb2 | Subtype I-U§§ | NA | NA | (RAMP) | Balac_1305 and GSU0054 |
| csb3 | Subtype I-U | NA | NA | (RAMP) | Balac_1303§§ |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2171 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

IV. Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule are described, e.g., in Jinek et al., SCIENCE 2012, 337(6096):816-821.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1×T4 polynucleotide kinase reaction buffer at 37° C. for 30 min, in a 50 µl, reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 µl. Reactions are initiated by the addition of 1 µl target DNA (10 nM) and incubated for 1 h at 37° C. Reactions are quenched by the addition of 20 µl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of Cas9 Molecule to Target DNA

Exemplary methods for evaluating the binding of Cas9 molecule to target DNA are described, e.g., in Jinek et al., SCIENCE 2012; 337(6096):816-821.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1×TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 μl.

Cas9 protein molecule is programmed with equimolar amounts of pre-annealed gRNA molecule and titrated from 100 μM to 1 μM. Radiolabeled DNA is added to a final concentration of 20 μM. Samples are incubated for 1 h at 37° C. and resolved at 4° C. on an 8% native polyacrylamide gel containing 1×TBE and 5 mM $MgCl_2$. Gels are dried and DNA visualized by phosphorimaging.

Differential Scanning Flourimetry (DSF)

The thermostability of Cas9-gRNA ribonucleoprotein (RNP) complexes can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10×SYPRO Orange® (Life Techonologies cat#S-6650) and dispensed into a 384 well plate. An equimolar amount of gRNA diluted in solutions with varied pH and salt is then added. After incubating at room temperature for 10' and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

The second assay consists of mixing various concentrations of gRNA with 2 uM Cas9 in optimal buffer from assay 1 above and incubating at RT for 10' in a 384 well plate. An equal volume of optimal buffer+10×SYPRO Orange® (Life Techonologies cat#S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 1° seconds.

V. Genome Editing Approaches

While not wishing to be bound by theory, altering the LCA10 target position may be achieved using one of the approaches discussed herein.

V.1 NHEJ Approaches for Gene Targeting

As described herein, nuclease-induced non-homologous end-joining (NHEJ) can be used to introduce indels at a target position. Nuclease-induced NHEJ can also be used to remove (e.g., delete) genomic sequence including the mutation at a target position in a gene of interest.

While not wishing to be bound by theory, it is believed that, in an embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of deletion.

Both double strand cleaving eaCas9 molecules and single strand, or nickase, eaCas9 molecules can be used in the methods and compositions described herein to generate break-induced indels.

Double Strand Break

In an embodiment, double strand cleavage is effected by a Cas9 molecule having cleavage activity associated with an HNH-like domain and cleavage activity associated with a RuvC-like domain, e.g., an N-terminal RuvC-like domain, e.g., a wild type Cas9. Such embodiments require only a single gRNA.

Single Strand Break

In other embodiments, two single strand breaks are effected by a Cas9 molecule having nickase activity, e.g., cleavage activity associated with an HNH-like domain or cleavage activity associated with an N-terminal RuvC-like domain. Such embodiments require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC therefore the Cas9 nickase has (only) HNH activity and will cut on the strand to which the gRNA hybridizes (the complementary strand, which does not have the NGG PAM on it). In other embodiments, a Cas9 molecule having an H840, e.g., an H840A, mutation can be used as a nickase. H840A inactivates HNH therefore the Cas9 nickase has (only) RuvC activity and cuts on the non-complementary strand (the strand that has the NGG PAM and whose sequence is identical to the gRNA). In other embodiments, a Cas9 molecule having an H863, e.g., an H863A, mutation can be used as a nickase. H863A inactivates HNH therefore the Cas9 nickase has (only) RuvC activity and cuts on the non-complementary strand (the strand that has the NGG PAM and whose sequence is identical to the gRNA).

In an embodiment, in which a nickase and two gRNAs are used to position two single strand breaks, one nick is on the + strand and one nick is on the—strand of the target nucleic acid. The PAMs can be outwardly facing. The gRNAs can be selected such that the gRNAs are separated by, from 0-50, 0-100, or 0-200 nucleotides. In an embodiment, there is no overlap between the target sequences that are complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran et al., Cell 2013; 154(6): 1380-1389).

Placement of Double Strand or Single Strand Breaks Relative to the Target Position In an embodiment, in which a gRNA and Cas9 nuclease generate a double strand break for the purpose of inducing break-induced indels, a gRNA, e.g., a unimolecular (or chimeric) or modular gRNA molecule, is configured to position one double-strand break in close proximity to a nucleotide of the target position. In an embodiment, the cleavage site is between 0-40 bp away from the target position (e.g., less than 40, 35, 30, 25, 20, 15, 10, 9, 8, 7, 6, 5, 4, 3, 2 or 1 bp from the target position).

In an embodiment, in which two gRNAs complexing with a Cas9 nickase induce two single strand breaks for the purpose of introducing break-induced indels, two gRNAs, e.g., independently, unimolecular (or chimeric) or modular gRNA, are configured to position two single-strand breaks to provide for NHEJ-mediated alteration of a nucleotide of the target position. In an embodiment, the gRNAs are configured to position cuts at the same position, or within a few nucleotides of one another, on different strands, essentially mimicking a double strand break. In an embodiment, the two nicks are between 0-40 bp away from the target position (e.g., less than 40, 35, 30, 25, 20, 15, 10, 9, 8, 7, 6, 5, 4, 3, 2 or 1 bp from the target position) respectively, and the two single strand breaks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of the target position. In an embodiment, the gRNAs are configured to place a single strand break on the same side (either 5' or 3') of the target position.

Regardless of whether a break is a double strand or a single strand break, the gRNA should be configured to avoid unwanted target chromosome elements, such as repeated elements, e.g., an Alu repeat, in the target domain. In addition, a break, whether a double strand or a single strand break, should be sufficiently distant from any sequence that should not be altered. For example, cleavage sites positioned within introns should be sufficiently distant from any intron/exon border, or naturally occurring splice signal, to avoid alteration of the exonic sequence or unwanted splicing events.

V.2 Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized.

V. 3 Other DNA Repair Pathways

SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott, Nature Reviews Genetics 9, 619-631 (August 2008), and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged'. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endoncuclease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Pol β, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways have a common feature in that they typically recognize a lesion on one strand of the DNA, then exo/endonucleaseases remove the lesion and leave a 1-30 nucleotide gap that is sub-sequentially filled in by DNA polymerase and finally sealed with ligase. A more complete picture is given in Li, Cell Research (2008) 18:85-98, and a summary is provided here.

Mismatch repair (MMR) operates on mispaired DNA bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutL α which possesses an ATPase activity and is important for multiple steps of MMR. It possesses a PCNA/replication factor C (RFC)-dependent endonuclease activity which plays an important role in 3' nick-directed MMR involving EXO1. (EXO1 is a participant in both HR and MMR.) It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott, Nature Reviews Genetics 9, 619-631 (August 2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Pol β that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn et al., Nature Reviews Molecular Cell Biology 15, 465-481 (2014), and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCCS) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA polζ and Rev1.

Error-free postreplication repair (PRR) is another pathway for repairing a single stranded break left after a defective replication event.

V.4 Examples of gRNAs in Genome Editing Methods gRNA molecules as described herein can be used with Cas9 molecules that cleave both or a single strand to alter the sequence of a target nucleic acid, e.g., of a target position or target genetic signature. gRNA molecules useful in these method are described below.

In an embodiment, the gRNA, e.g., a chimeric gRNA, molecule is configured such that it comprises one or more of the following properties;

a) it can position, e.g., when targeting a Cas9 molecule that makes double strand breaks, a double strand break (i) within 50, 100, 150 or 200 nucleotides of a target position, or (ii) sufficiently close that the target position is within the region of end resection;

b) it has a targeting domain of at least 17 nucleotides, e.g., a targeting domain of (i) 17, (ii) 18, or (iii) 20 nucleotides; and c)

(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus,* or *N. meningitidis* tail and proximal domain, or a sequence that differs by no more than 1, 2, 3, 4, 5; 6, 7, 8, 9 or 10 nucleotides therefrom;

(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus,* or *N. meningitidis* gRNA, or a sequence that differs by no more than 1, 2, 3, 4, 5; 6, 7, 8, 9 or 10 nucleotides therefrom;

(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus,* or *N. meningitidis* gRNA, or a sequence that differs by no more than 1, 2, 3, 4, 5, 6, 7, 8, 9 or 10 nucleotides therefrom;

iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus,* or *N. meningitidis* tail domain; or, or a sequence that differs by no more than 1, 2, 3, 4, 5, 6, 7, 8, 9 or 10 nucleotides therefrom; or (v) the tail domain comprises 15, 20, 25, 30, 35, 40 nucleotides or all of the corresponding portions of a naturally occurring tail domain, e.g., a naturally occurring *S. pyogenes, S. thermophilus, S. aureus,* or *N. meningitidis* tail domain.

In an embodiment, the gRNA molecule is configured such that it comprises properties: a(i); and b(i).

In an embodiment, the gRNA molecule is configured such that it comprises properties: a(i); and b(ii).

In an embodiment, the gRNA molecule is configured such that it comprises properties: a(i); and b(iii).

In an embodiment, the gRNA molecule is configured such that it comprises properties: a(ii); and b(i).

In an embodiment, the gRNA molecule is configured such that it comprises properties: a(ii); and b(ii).

In an embodiment, the gRNA molecule is configured such that it comprises properties: a(ii); and b(iii).

In an embodiment, the gRNA molecule is configured such that it comprises properties: b(i); and c(i).

In an embodiment, the gRNA molecule is configured such that it comprises properties: b(i); and c(ii).

In an embodiment, the gRNA molecule is configured such that it comprises properties: b(ii); and c(i).

In an embodiment, the gRNA molecule is configured such that it comprises properties: b(ii); and c(ii).

In an embodiment, the gRNA molecule is configured such that it comprises properties: b(iii); and c(i).

In an embodiment, the gRNA molecule is configured such that it comprises properties: b(iii); and c(ii).

In an embodiment, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at H840, e.g., a H840A.

In an embodiment, the gRNA is used with a Cas9 nickase molecule having RuvC activity, e.g., a Cas9 molecule having the HNH activity inactivated, e.g., a Cas9 molecule having a mutation at H863, e.g., a H863A.

In an embodiment, a pair of gRNA molecules, e.g., a pair of chimeric gRNA molecules, comprising a first and a second gRNA molecule, is configured such that they comprises one or more of the following properties:

a) the first and second gRNA molecules position, e.g., when targeting a Cas9 molecule that makes single strand or double strand breaks:

(i) as positioned by a first and second gRNA molecule described herein; or (ii) sufficiently close that the target position is altered when the break is repaired;

b) one or both, independently, has a targeting domain of at least 17 nucleotides, e.g., a targeting domain of (i) 17, (ii) 18, or (iii) 20 nucleotides; and c) one or both, independently, has a the tail domain is (i) at least 10, 15, 20, 25, 30, 35 or 40 nucleotides in length or (ii) the tail domain comprises, 15, 20, 25, 30, 35, 40, or all of the corresponding portions of a naturally occurring tail domain, e.g., a naturally occurring *S. pyogenes, S. aureus,* or *S. thermophilus* tail domain.

In an embodiment, one or both of the gRNA molecules is configured such that it comprises properties: a(i); and b(i).

In an embodiment, one or both of the gRNA molecules is configured such that it comprises properties: a(i); and b(ii).

In an embodiment, one or both of the gRNA molecules is configured such that it comprises properties: a(i); and b(iii).

In an embodiment, one or both of the gRNA molecules is configured such that it comprises properties: a(ii); and b(i).

In an embodiment, one or both of the gRNA molecules is configured such that it comprises properties: a(ii); and b(ii).

In an embodiment, one or both of the gRNA molecules is configured such that it comprises properties: a(ii); and b(iii).

In an embodiment, one or both of the gRNA molecules is configured such that it comprises properties: b(i); and c(i).

In an embodiment, one or both of the gRNA molecules is configured such that it comprises properties: b(i); and c(ii).

In an embodiment, one or both of the gRNA molecules is configured such that it comprises properties: b(ii); and c(i).

In an embodiment, one or both of the gRNA molecules is configured such that it comprises properties: b(ii); and c(ii).

In an embodiment, one or both of the gRNA molecules is configured such that it comprises properties: b(iii); and c(i).

In an embodiment, one or both of the gRNA molecules is configured such that it comprises properties: b(iii); and c(ii).

In an embodiment the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at H840, e.g., a H840A.

In an embodiment the gRNA is used with a Cas9 nickase molecule having RuvC activity, e.g., a Cas9 molecule having the HNH activity inactivated, e.g., a Cas9 molecule having a mutation at H863, e.g., a H863A.

VI. Targets: Cells

Cas9 molecules and gRNA molecules, e.g., a Cas9 molecule/gRNA molecule complex, can be used to manipulate a cell, e.g., to edit a target nucleic acid, in a wide variety of cells.

In some embodiments, a cell is manipulated by altering one or more target genes, e.g., as described herein. In some embodiments, the expression of one or more target genes (e.g., one or more target genes described herein) is modulated, e.g., in vivo.

In an embodiment, the target cell is a retinal cell, e.g., a cell of the retinal pigment epithelium cell or a photoreceptor cell. In another embodiment, the target cell is a horizontal cell, a bipolar cell, an amacrine cell, or a ganglion cell. In an embodiment, the target cell is a cone photoreceptor cell or cone cell, a rod photoreceptor cell or rod cell, or a macular cone photoreceptor cell. In an exemplary embodiment, cone photoreceptors in the macula are targeted, i.e., cone photoreceptors in the macula are the target cells.

In an embodiment, the target cell is removed from the subject, the gene altered ex vivo, and the cell returned to the subject. In an embodiment, a photoreceptor cell is removed from the subject, the gene altered ex vivo, and the photoreceptor cell returned to the subject. In an embodiment, a cone photoreceptor cell is removed from the subject, the gene altered ex vivo, and the cone photoreceptor cell returned to the subject.

In an embodiment, the cells are induced pluripotent stem cells (iPS) cells or cells derived from iPS cells, e.g., iPS cells from the subject, modified to alter the gene and differentiated into retinal progenitor cells or retinal cells, e.g., retinal photoreceptors, and injected into the eye of the subject, e.g., subretinally, e.g., in the submacular region of the retina.

In an embodiment, the cells are targeted in vivo, e.g., by delivery of the components, e.g., a Cas9 molecule and a gRNA molecule, to the target cells. In an embodiment, the target cells are retinal pigment epithelium, photoreceptor cells, or a combination thereof. In an embodiment, AAV is used to deliver the components, e.g., a Cas9 molecule and a gRNA molecule, e.g., by transducing the target cells.

VII. Delivery, Formulations and Routes of Administration

The components, e.g., a Cas9 molecule and gRNA molecule can be delivered, formulated, or administered in a variety of forms, see, e.g., Table 17. In an embodiment, one Cas9 molecule and two or more (e.g., 2, 3, 4, or more) different gRNA molecules are delivered, e.g., by an AAV vector. In an embodiment, the sequence encoding the Cas9 molecule and the sequence(s) encoding the two or more (e.g., 2, 3, 4, or more) different gRNA molecules are present on the same nucleic acid molecule, e.g., an AAV vector. When a Cas9 or gRNA component is delivered encoded in DNA the DNA will typically include a control region, e.g., comprising a promoter, to effect expression. Useful promoters for Cas9 molecule sequences include CMV, EFS, EF-1a, MSCV, PGK, CAG, hGRK1, hCRX, hNRL, and hRCVRN control promoters. In an embodiment, the promoter is a constitutive promoter. In another embodiment, the promoter is a tissue specific promoter. Exemplary promoter sequences are disclosed in Table 19. Useful promoters for gRNAs include H1, 7SK, and U6 promoters. Promoters with similar or dissimilar strengths can be selected to tune the expression of components. Sequences encoding a Cas9 molecule can comprise a nuclear localization signal (NLS), e.g., an SV40 NLS. In an embodiment, the sequence encoding a Cas9 molecule comprises at least two nuclear localization signals. In an embodiment a promoter for a Cas9 molecule or a gRNA molecule can be, independently, inducible, tissue specific, or cell specific. To detect the expression of a Cas9, an affinity tag can be used. Useful affinity tag sequences include, but are not limited to, 3×Flag tag, single Flag tag, HA tage, Myc tag or HIS tage. Exemplary affinity tage sequences are disclosed in Table 25. To regulate Cas9 expression, e.g., in mammalian cells, polyadenylation signals (poly(A) signals) can be used. Exemplary polyadenylation signals are disclosed in Table 26.

Table 17 provides examples of how the components can be formulated, delivered, or administered.

TABLE 17

| Cas9 Molecule(s) | gRNA molecule(s) | Comments |
|---|---|---|
| DNA | DNA | In this embodiment a Cas9 molecule, typically an eaCas9 molecule, and a gRNA are transcribed from DNA. In this embodiment they are encoded on separate molecules. |
|  | DNA | In this embodiment a Cas9 molecule, typically an eaCas9 molecule, and a gRNA are transcribed from DNA, here from a single molecule. |
| DNA | RNA | In this embodiment a Cas9 molecule, typically an eaCas9 molecule, is transcribed from DNA. |
| mRNA | RNA | In this embodiment a Cas9 molecule, typically an eaCas9 molecule, is transcribed from DNA. |

TABLE 17-continued

| Cas9 Molecule(s) | gRNA molecule(s) | Comments |
|---|---|---|
| Protein | DNA | In this embodiment a Cas9 molecule, typically an eaCas9 molecule, is provided as a protein. A gRNA is transcribed from DNA. |
| Protein | RNA | In this embodiment an eaCas9 molecule is provided as a protein. |

Table 18 summarizes various delivery methods for the components of a Cas system, e.g., the Cas9 molecule component and the gRNA molecule component, as described herein.

TABLE 18

| Delivery Vector/Mode | | Delivery into Non-Dividing Cells | Duration of Expression | Genome Integration | Type of Molecule Delivered |
|---|---|---|---|---|---|
| Physical (e.g., electroporation, particle gun, Calcium Phosphate transfection) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

Table 19 describes exemplary promoter sequences that can be used in AAV vectors, e.g., for Cas9 expression.

TABLE 19

| Promoter | Length (bp) | DNA Sequence |
|---|---|---|
| CMV | 617 | CATTGATTATTGACTAGTTATTAATAGTAATCAATTACGG GGTCATTAGTTCATAGCCCATATATGGAGTTCCGCGTTAC ATAACTTACGGTAAATGGCCCGCCTGGCTGACCGCCCAA CGACCCCCGCCCATTGACGTCAATAATGACGTATGTTCCC ATAGTAACGCCAATAGGGACTTTCCATTGACGTCAATGG GTGGACTATTTACGGTAAACTGCCCACTTGGCAGTACATC AAGTGTATCATATGCCAAGTACGCCCCCTATTGACGTCAA TGACGGTAAATGGCCCGCCTGGCATTATGCCCAGTACAT GACCTTATGGGACTTTCCTACTTGGCAGTACATCTACGTA TTAGTCATCGCTATTACCATGGTGATGCGGTTTTGGCAGT ACATCAATGGGCGTGGATAGCGGTTTGACTCACGGGGAT TTCCAAGTCTCCACCCCATTGACGTCAATGGGAGTTTGTT TTGGCACCAAAATCAACGGGACTTTCCAAAATGTCGTAA |

TABLE 19-continued

| Promoter | Length (bp) | DNA Sequence |
|---|---|---|
| | | CAACTCCGCCCCATTGACGCAAATGGGCGGTAGGCGTGT ACGGTGGGAGGTCTATATAAGCAGAGCTGGTTTAGTGAA CCGTCAGATCCGCTAGAGATCCGC (SEQ ID NO: 401) |
| EFS | 252 | TCGAGTGGCTCCGGTGCCCGTCAGTGGGCAGAGCGCACA TCGCCCACAGTCCCCGAGAAGTTGGGGGGAGGGGTCGGC AATTGAACCGGTGCCTAGAGAAGGTGGCGCGGGGTAAAC TGGGAAAGTGATGTCGTGTACTGGCTCCGCCTTTTTCCCG AGGGTGGGGGAGAACCGTATATAAGTGCAGTAGTCGCCG TGAACGTTCTTTTTCGCAACGGGTTTGCCGCCAGAACACA GGTGTCGTGACCGCGG (SEQ ID NO: 402) |
| Human GRK1 (rhodopsin kinase) | 292 | GGGCCCCAGAAGCCTGGTGGTTGTTTGTCCTTCTCAGGGG AAAAGTGAGGCGGCCCCTTGGAGGAAGGGGCCGGGCAG AATGATCTAATCGGATTCCAAGCAGCTCAGGGGATTGTCT TTTTCTAGCACCTTCTTGCCACTCCTAAGCGTCCTCCGTGA CCCCGGCTGGGATTTCGCCTGGTGCTGTGTCAGCCCCGGT CTCCCAGGGGCTTCCCAGTGGTCCCCAGGAACCCTCGAC AGGGCCCGGTCTCTCTCGTCCAGCAAGGGCAGGGACGGG CCACAGGCCAAGGGC (SEQ ID NO: 403) |
| Human CRX (cone rod homeobox transcription factor) | 113 | GCCTGTAGCCTTAATCTCTCCTAGCAGGGGGTTTGGGGGA GGGAGGAGGAGAAAGAAAGGGCCCCTTATGGCTGAGAC ACAATGACCCAGCCACAAGGAGGGATTACCGGGCG (SEQ ID NO: 404) |
| Human NRL (neural retina leucine zipper transcription factor enhance upstream of the human TK terminal promoter) | 281 | AGGTAGGAAGTGGCCTTTAACTCCATAGACCCTATTTAAA CAGCTTCGGACAGGTTTAAACATCTCCTTGGATAATTCCT AGTATCCCTGTTCCCACTCCTACTCAGGGATGATAGCTCT AAGAGGTGTTAGGGGATTAGGCTGAAAATGTAGGTCACC CCTCAGCCATCTGGGAACTAGAATGAGTGAGAGAGGAGA GAGGGGCAGAGACACACACATTCGCATATTAAGGTGACG CGTGTGGCCTCGAACACCGAGCGACCCTGCAGCGACCCG CTTAA (SEQ ID NO: 405) |
| Human RCVRN (recoverin) | 235 | ATTTTAATCTCACTAGGGTTCTGGGAGCACCCCCCCCCAC CGCTCCCGCCCTCCACAAAGCTCCTGGGCCCCTCCTCCCT TCAAGGATTGCGAAGAGCTGGTCGCAAATCCTCCTAAGC CACCAGCATCTCGGTCTTCAGCTCACACCAGCCTTGAGCC CAGCCTGCGGCCAGGGGACCACGCACGTCCCACCCACCC AGCGACTCCCCAGCCGCTGCCCACTCTTCCTCACTCA (SEQ ID NO: 406) |

| Affinity tag | Amino Acid Sequence |
|---|---|
| 3XFlag tag | DYKDHDGDYKDHDIDYKDDDDK (SEQ ID NO: 426) |
| Flag tag (single) | DYKDDDDK (SEQ ID NO: 451) |
| HA tag | YPYDVPDYA (SEQ ID NO: 452) |
| Myc tag | EQKLISEEDL (SEQ ID NO: 453) |
| HIS tag | HHHHHH (SEQ ID NO: 454) |

Table 25 describes exemplary affinity tag sequences that can be used in AAV vectors, e.g., for Cas9 expression.

| PolyA | DNA sequence |
|---|---|
| mini polyA | TAGCAATAAAGGATCGTTTATTTTCATTGGAAGCGTGTGT TGGTTTTTTGATCAGGCGCG (SEQ ID NO: 424) |
| bGH polyA | GCTGCAGGATGACCGGTCATCATCACCATCACCATTGAG TTTAAACCCGCTGATCAGCCTCGACTGTGCCTTCTAGTTG CCAGCCATCTGTTGTTTGCCCCTCCCCCGTGCCTTCCTTGA CCCTGGAAGGTGCCACTCCCACTGTCCTTTCCTAATAAAA TGAGGAAATTGCATCGCATTGTCTGAGTAGGTGTCATTCT ATTCTGGGGGGTGGGGTGGGGCAGGACA (SEQ ID NO: 455) |
| SV40 polyA | ATGCTTTATTTGTGAAATTTGTGATGCTATTGCTTTATTTG TAACCATTATAAGCTGCAATAAACAAGTTAACAACAACA ATTGCATTCATTTTATGTTTCAGGTTCAGGGGGAGGTGTG GGAGGTTTTTTAAA (SEQ ID NO: 456) |

Table 26 describes exemplary polyA sequences that can be used in AAV vectors, e.g., for Cas9 expression.

Table 24 describes exemplary Inverted Terminal Repeat (ITR) sequences that can be used in AAV vectors.

TABLE 24

Sequences of ITRs from exemplary AAV Serotypes

| AAV Serotype | Left ITR Sequence | Right ITR Sequence |
|---|---|---|
| AAV1 | TTGCCCACTCCCTCTCTGCGCGCTCGCTCGCTCGGTGGGGCCTGCGGACCAAAGGTCCGCAGACGGCAGAGCTCTGCTCTGCCGGCCCCACCGAGCGAGCGAGCGCGCAGAGAGGGAGTGGGCAACTCCATCACTAGGGGTAA (SEQ ID NO: 407) | TTACCCCTAGTGATGGAGTTGCCCACTCCCTCTCTGCGCGCTCGCTCGCTCGGTGGGGCCGGCAGAGCAGAGCTCTGCCGTCTGCGGACCTTTGGTCCGCAGGCCCCACCGAGCGAGCGAGCGCGCAGAGAGGGAGTGGGCAA (SEQ ID NO: 436) |
| AAV2 | TTGGCCACTCCCTCTCTGCGCGCTCGCTCGCTCACTGAGGCCGGGCGACCAAAGGTCGCCCGACGCCCGGGCTTTGCCCGGGCGGCCTCAGTGAGCGAGCGAGCGCGCAGAGAGGGAGTGGCCAACTCCATCACTAGGGGTTCCT (SEQ ID NO: 408) | AGGAACCCCTAGTGATGGAGTTGGCCACTCCCTCTCTGCGCGCTCGCTCGCTCACTGAGGCCGCCCGGGCAAAGCCCGGGCGTCGGGCGACCTTTGGTCGCCCCGGCCTCAGTGAGCGAGCGAGCGCGCAGAGAGGAGTGGCCAA (SEQ ID NO: 437) |
| AAV3B | TGGCCACTCCCTCTATGCGCACTCGCTCGCTCGGTGGGGCCTGGCGACCAAAGGTCGCCAGACGGACGTGCTTTGCACGTCCGGCCCCACCGAGCGAGCGAGTGCGCATAGAGGGAGTGGCCAACTCCATCACTAGAGGTAT (SEQ ID NO: 409) | ATACCTCTAGTGATGGAGTTGGCCACTCCCTCTATGCGCACTCGCTCGCTCGGTGGGGCCGGACGTGCAAAGCACGTCCGTCTGGCGACCTTTGGTCGCCAGGCCCCACCGAGCGAGCGAGTGCGCATAGAGGGAGTGGCCA (SEQ ID NO: 438) |
| AAV4 | TTGGCCACTCCCTCTATGCGCGCTCGCTCACTCACTCGGCCCTGGAGACCAAAGGTCTCCAGACTGCCGGCCTCTGGCCGGCAGGGCCGAGTGAGTGAGCGAGCGCGCATAGAGGGAGTGGCCAACTCCATCATCTAGGTTTGCCC (SEQ ID NO: 410) | GGGCAAACCTAGATGATGGAGTTGGCCACTCCCTCTATGCGCGCTCGCTCACTCACTCGGCCCTGCCGGCCAGAGGCCGGCAGTCTGGAGACCTTTGGTCTCCAGGGCCGAGTGAGTGAGCGAGCGCGCATAGAGGGAGTGGCCAA (SEQ ID NO: 439) |
| AAV5 | CTCTCCCCCCTGTCGCGTTCGCTCGCTCGCTGGCTCGTTTGGGGGGGTGGCAGCTCAAAGAGCTGCCAGACGACGGCCCTCTGGCCGTCGCCCCCCCAAACGAGCCAGCGAGCGAGCGAACGCGACAGGGGGGAGAGTGCCACACTCTCAAGCAA (SEQ ID NO: 411) | TTGCTTGAGAGTGTGGCACTCTCCCCCCTGTCGCGTTCGCTCGCTCGCTGGCTCGTTTTGGGGGGGCGACGGCCAGAGGGCCGTCGTCTGGCAGCTCTTTGAGCTGCCACCCCCCAAACGAGCCAGCGAGCGAGCGAACGCGACAGGGGGGAGAG (SEQ ID NO: 440) |
| AAV6 | ATACCCCTAGTGATGGAGTTGCCCACTCCCTCTATGCGCGCTCGCTCGCTCGGTGGGGCCGGCAGAGCAGAGCTCTGCCGTCTGCGGACCTTTGGTCCGCAGGCCCCACCGAGCGAGCGAGCGCGCATAGAGGGAGTGGGCAA (SEQ ID NO: 412) | TTGCCCACTCCCTCTATGCGCGCTCGCTCGCTCGGTGGGGCCTGCGGACCAAAGGTCCGCAGACGGCAGAGCTCTGCTCTGCCGGCCCCACCGAGCGAGCGAGCGCGCATAGAGGGAGTGGGCAACTCCATCACTAGGGGTAT (SEQ ID NO: 441) |
| AAV7 | TTGGCCACTCCCTCTATGCGCGCTCGCTCGCTCGGTGGGGCCTGCGGACCAAAGGTCCGCAGACGGCAGAGCTCTGCTCTGCCGGCCCCACCGAGCGAGCGAGCGCGCATAGAGGGAGTGGCCAACTCCATCACTAGGGGTACCG (SEQ ID NO: 413) | CGGTACCCCTAGTGATGGAGTTGGCCACTCCCTCTATGCGCGCTCGCTCGCTCGGTGGGGCCGGCAGAGCAGAGCTCTGCCGTCTGCGGACCTTTGGTCCGCAGGCCCCACCGAGCGAGCGAGCGCGCATAGAGGGAGTGGCCAA (SEQ ID NO: 442) |
| AAV8 | CAGAGAGGGAGTGGCCAACTCCATCACTAGGGGTAGCGCGAAGCGCCTCCCACGCTGCCGCGTCAGCGCTGACGTAAATTACGTCATAGGGGAGTGGTCCTGTATTAGCTGTCACGTGAGTGCTTTTGCGGCATTTTGCGACACC (SEQ ID NO: 414) | GGTGTCGCAAAATGCCGCAAAAGCACTCACGTGACAGCTAATACAGGACCACTCCCCTATGACGTAATTTACGTCAGCGCTGACGCGGCAGCGTGGGAGGCGCTTCGCGCTACCCCTAGTGATGGAGTTGGCCACTCCCTCTCTG (SEQ ID NO: 443) |
| AAV9 | CAGAGAGGGAGTGGCCAACTCCATCACTAGGGGTAATCGCGAAGCGCCTCCCACGCTGCCGCGTCAGCGCTGACGTAGATTACGTCATAGGGGAGTGGTCCTGTATTAGCTGTCACGTGAGTGCTTTTGCGACATTTTGCGACAC (SEQ ID NO: 415) | GTGTCGCAAAATGTCGCAAAAGCACTCACGTGACAGCTAATACAGGACCACTCCCCTATGACGTAATCTACGTCAGCGCTGACGCGGCAGCGTGGGAGGCGCTTCGCGATTACCCCTAGTGATGGAGTTGGCCACTCCCTCTCTG (SEQ ID NO: 444) |

Additional exemplary sequences for the recombinant AAV genome components described herein are provided below.

Exemplary Left and right ITR sequences are provided in Table 24 (SEQ ID NOS: 407-415 and 436-444).

Exemplary spacer 1 sequence: CAGATCTGAATTCGGTACC (SEQ ID NO: 416).

Exemplary U6 promoter sequence:

(SEQ ID NO: 417)
AAGGTCGGGCAGGAAGAGGGCCTATTTCCCATGATTCCTTCATATTTG

CATATACGATACAAGGCTGTTAGAGAGATAATTAGAATTAATTTGACTG

TAAACACAAAGATATTAGTACAAAATACGTGACGTAGAAAGTAATAAT

TTCTTGGGTAGTTTGCAGTTTTAAAATTATGTTTTAAAATGGACTATCA

TATGCTTACCGTAACTTGAAAGTATTTCGATTTCTTGGCTTTATATATC

TTGTGGAAAGGACGAAACACC

Exemplary gRNA targeting domain sequences are described herein, e.g., in Tables 1A-1D, Tables 2A-2C, Tables 3A-3D, Tables 4A-4D, Tables 5A-5B, Tables 6A-6D, Tables 7A-7D, Tables 8A-8E, Tables 9A-9B, or Table 10.

Exemplary gRNA scaffold domain sequence:

(SEQ ID NO: 418)
GTTTTAGTACTCTGGAAACAGAATCTACTAAAACAAGGCAAAATGCCGT

GTTTATCTCGTCAACTTGTTGGCGAGATTTTTT.

Exemplary spacer 2 domain sequence:

(SEQ ID NO: 419)
GGTACCGCTAGCGCTTAAGTCGCGATGTACGGGCCAGATATACGCGT

TGA.

Exemplary Polymerase II promoter sequences are provided in Table 19.

Exemplary N-ter NLS nucleotide sequence:

(SEQ ID NO: 420)
CCGAAGAAAAAGCGCAAGGTCGAAGCGTCC

Exemplary N-ter NLS amino acid sequence: PKKKRKV (SEQ ID NO: 434)

Exemplary Cas9 nucleotide sequence:

(SEQ ID NO: 421)
ATGAAAAGGAACTACATTCTGGGGCTGGACATCGGGATTACAAGCGTGG

GGTATGGGATTATTGACTATGAAACAAGGGACGTGATCGACGCAGGCGT

CAGACTGTTCAAGGAGGCCAACGTGGAAAACAATGAGGGACGGAGAAGC

AAGAGGGAGCCAGGCGCCTGAAACGACGGAGAAGGCACAGAATCCAGA

GGGTGAAGAAACTGCTGTTCGATTACAACCTGCTGACCGACCATTCTGA

GCTGAGTGGAATTAATCCTTATGAAGCCAGGGTGAAAGGCCTGAGTCAG

AAGCTGTCAGAGGAAGAGTTTTCCGCAGCTCTGCTGCACCTGGCTAAGC

GCCGAGGAGTGCATAACGTCAATGAGGTGGAAGAGGACACCGGCAACGA

GCTGTCTACAAAGGAACAGATCTCACGCAATAGCAAAGCTCTGGAAGAG

AAGTATGTCGCAGAGCTGCAGCTGGAACGGCTGAAGAAAGATGGCGAGG

TGAGAGGGTCAATTAATAGGTTCAAGACAAGCGACTACGTCAAAGAAGC

CAAGCAGCTGCTGAAAGTGCAGAAGGCTTACCACCAGCTGGATCAGAGC

TTCATCGATACTTATATCGACCTGCTGGAGACTCGGAGAACCTACTATG

AGGGACCAGGAGAAGGGAGCCCCTTCGGATGGAAAGACATCAAGGAATG

GTACGAGATGCTGATGGACATTGCACCTATTTTCCAGAAGAGCTGAGA

AGCGTCAAGTACGCTTATAACGCAGATCTGTACAACGCCCTGAATGACC

TGAACAACCTGGTCATCACCAGGGATGAAAACGAGAAACTGGAATACTA

TGAGAAGTTCCAGATCATCGAAAACGTGTTTAAGCAGAAGAAAAAGCCT

ACACTGAAACAGATTGCTAAGGAGATCCTGGTCAACGAAGAGGACATCA

AGGGCTACCGGGTGACAAGCACTGGAAAACCAGAGTTCACCAATCTGAA

AGTGTATCACGATATTAAGGACATCACAGCACGGAAAGAAATCATTGAG

AACGCCGAACTGCTGGATCAGATTGCTAAGATCCTGACTATCTACCAGA

GCTCCGAGGACATCCAGGAAGAGCTGACTAACCTGAACAGCGAGCTGAC

CCAGGAAGAGATCGAACAGATTAGTAATCTGAAGGGGTACACCGGAACA

CACAACCTGTCCCTGAAAGCTATCAATCTGATTCTGGATGAGCTGTGGC

ATACAAACGACAATCAGATTGCAATCTTTAACCGGCTGAAGCTGGTCCC

AAAAAAGGTGGACCTGAGTCAGCAGAAAGAGATCCCAACCACACTGGTG

GACGATTTCATTCTGTCACCCGTGGTCAAGCGGAGCTTCATCCAGAGCA

TCAAAGTGATCAACGCCATCATCAAGAAGTACGGCCTGCCCAATGATAT

CATTATCGAGCTGGCTAGGGAGAAGAACAGCAAGGACGCACAGAAGATG

ATCAATGAGATGCAGAAACGAAACCGGCAGACCAATGAACGCATTGAAG

AGATTATCCGAACTACCGGGAAAGAGAACGCAAAGTACCTGATTGAAAA

AATCAAGCTGCACGATATGCAGGAGGGAAAGTGTCTGTATTCTCTGGAG

GCCATCCCCCTGGAGGACCTGCTGAACAATCCATTCAACTACGAGGTCG

ATCATATTATCCCCAGAAGCGTGTCCTTCGACAATTCCTTTAACAACAA

GGTGCTGGTCAAGCAGGAAGAGAACTCTAAAAAGGGCAATAGGACTCCT

TTCCAGTACCTGTCTAGTTCAGATTCCAAGATCTCTTACGAAACCTTTA

AAAAGCACATTCTGAATCTGGCCAAAGGAAAGGGCCGCATCAGCAAGAC

CAAAAAGGAGTACCTGCTGGAAGAGCGGGACATCAACAGATTCTCCGTC

CAGAAGGATTTTATTAACCGGAATCTGGTGGACACAAGATACGCTACTC

GCGGCCTGATGAATCTGCTGCGATCCTATTTCCGGGTGAACAATCTGGA

TGTGAAAGTCAAGTCCATCAACGGCGGGTTCACATCTTTTCTGAGGCGC

AAATGGAAGTTTAAAAAGGAGCGCAACAAAGGGTACAAGCACCATGCCG

AAGATGCTCTGATTATCGCAAATGCCGACTTCATCTTTAAGGAGTGGAA

AAAGCTGGACAAAGCCAAGAAAGTGATGGAGAACCAGATGTTCGAAGAG

AAGCAGGCCGAATCTATGCCCGAAATCGAGACAGAACAGGAGTACAAGG

AGATTTTCATCACTCCTCACCAGATCAAGCATATCAAGGATTTCAAGGA

CTACAAGTACTCTCACCGGGTGGATAAAAAGCCCAACAGAGAGCTGATC

AATGACACCCTGTATAGTACAAGAAAAGACGATAAGGGGAATACCCTGA

TTGTGAACAATCTGAACGGACTGTACGACAAAGATAATGACAAGCTGAA

AAAGCTGATCAACAAAAGTCCCGAGAAGCTGCTGATGTACCACCATGAT

CCTCAGACATATCAGAAACTGAAGCTGATTATGGAGCAGTACGGCGACG

AGAAGAACCCACTGTATAAGTACTATGAAGACTGGGAACTACCTGAC

CAAGTATAGCAAAAGGATAATGGCCCCGTGATCAAGAAGATCAAGTAC

TATGGGAACAAGCTGAATGCCCATCTGGACATCACAGACGATTACCCTA

ACAGTCGCAACAAGGTGGTCAAGCTGTCACTGAAGCCATACAGATTCGA

TGTCTATCTGGACAACGGCGTGTATAAATTTGTGACTGTCAAGAATCTG

GATGTCATCAAAAAGGAGAACTACTATGAAGTGAATAGCAAGTGCTACG

AAGAGGCTAAAAAGCTGAAAAAGATTAGCAACCAGGCAGAGTTCATCGC

CTCCTTTTACAACAACGACCTGATTAAGATCAATGGCGAACTGTATAGG

-continued

GTCATCGGGGTGAACAATGATCTGCTGAACCGCATTGAAGTGAATATGA

TTGACATCACTTACCGAGAGTATCTGGAAAACATGAATGATAAGCGCCC

CCCTCGAATTATCAAAACAATTGCCTCTAAGACTCAGAGTATCAAAAAG

TACTCAACCGACATTCTGGGAAACCTGTATGAGGTGAAGAGCAAAAAGC

ACCCTCAGATTATCAAAAGGGC

Exemplary Cas9 amino acid sequence:

(SEQ ID NO: 435)
MKRNYILGLDIGITSVGYGIIDYETRDVIDAGVRLFKEANVENNEGRRS

KRGARRLKRRRRHRIQRVKKLLFDYNLLTDHSELSGINPYEARVKGLSQ

KLSEEEFSAALLHLAKRRGVHNVNEVEEDTGNELSTKEQISRNSKALEE

KYVAELQLERLKKDGEVRGSINRFKTSDYVKEAKQLLKVQKAYHQLDQS

FIDTYIDLLETRRTYYEGPGEGSPFGWKDIKEWYEMLMGHCTYFPEELR

SVKYAYNADLYNALNDLNNLVITRDENEKLEYYEKFQIIENVFKQKKKP

TLKQIAKEILVNEEDIKGYRVTSTGKPEFTNLKVYHDIKDITARKEIIE

NAELLDQIAKILTIYQSSEDIQEELTNLNSELTQEEIEQISNLKGYTGT

HNLSLKAINLILDELWHTNDNQIAIFNRLKLVPKKVDLSQQKEIPTTLV

DDFILSPVVKRSFIQSIKVINAIIKKYGLPNDIIIELAREKNSKDAQKM

INEMQKRNRQTNERIEEIIRTTGKENAKYLIEKIKLHDMQEGKCLYSLE

AIPLEDLLNNPFNYEVDHIIPRSVSFDNSFNNKVLVKQEENSKKGNRTP

FQYLSSSDSKISYETFKKHILNLAKGKGRISKTKKEYLLEERDINRFSV

QKDFINRNLVDTRYATRGLMNLLRSYFRVNNLDVKVKSINGGFTSFLRR

KWKFKKERNKGYKHHAEDALIIANADFIFKEWKKLDKAKKVMENQMFEE

KQAESMPEIETEQEYKEIFITPHQIKHIKDFKDYKYSHRVDKKPNRELI

NDTLYSTRKDDKGNTLIVNNLNGLYDKDNDKLKKLINKSPEKLLMYHHD

PQTYQKLKLIMEQYGDEKNPLYKYYEETGNYLTKYSKKDNGPVIKKIKY

YGNKLNAHLDITDDYPNSRNKVVKLSLKPYRFDVYLDNGVYKFVTVKNL

DVIKKENYYEVNSKCYEEAKKLKKISNQAEFIASFYNNDLIKINGELYR

VIGVNNDLLNRIEVNMIDITYREYLENMNDKRPPRIIKTIASKTQSIKK

YSTDILGNLYEVKSKKHPQIIKKG

Exemplary C-ter NLS sequence: CCCAAGAAGAAGAGGAAAGTC (SEQ ID NO: 422).

Exemplary C-ter NLS amino acid sequence: PKKKRKV (SEQ ID NO: 434)

Exemplary poly(A) signal sequence:

(SEQ ID NO: 424)
TAGCAATAAAGGATCGTTTATTTTCATTGGAAGCGTGTGTTGGTTTTTT

GATCAGGCGCG.

Exemplary Spacer 3 sequence:

(SEQ ID NO: 425)
TCCAAGCTTCGCAGGAAAGAACATGTGAGCAAAAGGCCAGCAAAGGCG

TTAACTCTAGATTTAAATGCATGCTGGGGAGAGATCT

Exemplary 3×FLAG nucleotide sequence:

(SEQ ID NO: 423)
GACTACAAAGACCATGACGGTGATTATAAAGATCATGACATCGATTACA

AGGATGACGATGACAAG.

Exemplary 3×FLAG amino acid sequence:

(SEQ ID NO: 426)
DYKDHDGDYKDHDIDYKDDDDK

Exemplary Spacer 4 sequence: CGACTTAGTTCGATCGAAGG (SEQ ID NO: 427).

Exemplary recombinant AAV genome sequences are provided in FIGS. 19A-24F (SEQ IDNOS: 428-433 and 445-450). Exemplary sequences of the recombinant AAV genome components (e.g., one or more of the components described above) are also shown in FIGS. 19A-24F (SEQ IDNOS: 428-433 and 445-450).

DNA-Based Delivery of a Cas9 Molecule and or a gRNA Molecule

Nucleic acids encoding Cas9 molecules (e.g., eaCas9 molecules) and/or gRNA molecules, can be administered to subjects or delivered into cells by art-known methods or as described herein. For example, Cas9-encoding and/or gRNA-encoding DNA can be delivered, e.g., by vectors (e.g., viral or non-viral vectors), non-vector based methods (e.g., using naked DNA or DNA complexes), or a combination thereof.

DNA encoding Cas9 molecules (e.g., eaCas9 molecules) and/or gRNA molecules can be conjugated to molecules (e.g., N-acetylgalactosamine) promoting uptake by the target cells (e.g., the target cells described herein). Donor template molecules can be conjugated to molecules (e.g., N-acetylgalactosamine) promoting uptake by the target cells (e.g., the target cells described herein).

In some embodiments, the Cas9- and/or gRNA-encoding DNA is delivered by a vector (e.g., viral vector/virus or plasmid).

A vector can comprise a sequence that encodes a Cas9 molecule and/or a gRNA molecule. A vector can also comprise a sequence encoding a signal peptide (e.g., for nuclear localization, nucleolar localization, mitochondrial localization), fused, e.g., to a Cas9 molecule sequence. For example, a vector can comprise a nuclear localization sequence (e.g., from SV40) fused to the sequence encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In some embodiments, the promoter is a viral promoter. In other embodiments, the promoter is a non-viral promoter.

In some embodiments, the vector or delivery vehicle is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects dividing cells. In other embodiments, the virus infects non-dividing cells. In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In an embodiment, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the target cell surface (e.g., a ligand-receptor, monoclonal antibody, avidin-biotin and chemical conjugation).

In some embodiments, the Cas9- and/or gRNA-encoding DNA is delivered by a recombinant retrovirus. In some embodiments, the retrovirus (e.g., Moloney murine leukemia virus) comprises a reverse transcriptase, e.g., that allows integration into the host genome. In some embodiments, the retrovirus is replication-competent. In other embodiments, the retrovirus is replication-defective, e.g., having one of more coding regions for the genes necessary for additional rounds of virion replication and packaging replaced with other genes, or deleted. In some embodiments, the Cas9- and/or gRNA-encoding DNA is delivered by a recombinant lentivirus. For example, the lentivirus is replication-defective, e.g., does not comprise one or more genes required for viral replication.

In some embodiments, the Cas9- and/or gRNA-encoding DNA is delivered by a recombinant adenovirus. In some embodiments, the adenovirus is engineered to have reduced immunity in human.

In some embodiments, the Cas9- and/or gRNA-encoding DNA is delivered by a recombinant AAV. In some embodiments, the AAV does not incorporate its geneome into that of a host cell, e.g., a target cell as describe herein. In some embodiments, the AAV can incorporate at least part of its genome into that of a host cell, e.g., a target cell as described herein. In some embodiments, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh10, and pseudotyped AAV, such as AAV2/8, AAV2/5 and AAV2/6 can also be used in the disclosed methods. In an embodiment, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV.rh32/33, AAV.rh43, AAV.rh64R1, or AAV7m8. Exemplary AAV serotypes and ITR sequences are disclosed in Table 24.

In an embodiment, the Cas9- and/or gRNA-encoding DNA is delivered in a re-engineered AAV capsid, e.g., with 50% or greater, e.g., 60% or greater, 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV.rh64R1.

In an embodiment, the Cas9- and/or gRNA-encoding DNA is delivered by a chimeric AAV capsid. Exemplary chimeric AAV capsids include, but are not limited to, AAV9i1, AAV2i8, AAV-DJ, AAV2G9, AAV2i8G9, or AAV8G9.

In an embodiment, the AAV is a self-complementary adeno-associated virus (scAAV), e.g., a scAAV that packages both strands which anneal together to form double stranded DNA.

In some embodiments, the Cas9- and/or gRNA-encoding DNA is delivered by a hybrid virus, e.g., a hybrid of one or more of the viruses described herein. In an embodiment, the hybrid virus is hybrid of an AAV (e.g., of any AAV serotype), with a Bocavirus, B19 virus, porcine AAV, goose AAV, feline AAV, canine AAV, or MVM.

A packaging cell is used to form a virus particle that is capable of infecting a target cell. Such a cell includes a 293 cell, which can package adenovirus, and a ψ2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, e.g., Cas9. For example, an AAV vector used in gene therapy typically only possesses inverted terminal repeat (ITR) sequences from the AAV genome which are required for packaging and gene expression in the host or target cell. The missing viral functions can be supplied in trans by the packaging cell line and/or plasmid containing E2A, E4, and VA genes from adenovirus, and plasmid encoding Rep and Cap genes from AAV, as described in "Triple Transfection Protocol." Henceforth, the viral DNA is packaged in a cell line, which contains a helper plasmid encoding the other AAV genes, namely rep and cap, but lacking ITR sequences. In embodiment, the viral DNA is packaged in a producer cell line, which contains E1A and/or E1B genes from adenovirus. The cell line is also infected with adenovirus as a helper. The helper virus (e.g., adenovirus or HSV) or helper plasmid promotes replication of the AAV vector and expression of AAV genes from the plasmid with ITRs. The helper plasmid is not packaged in significant amounts due to a lack of ITR sequences. Contamination with adenovirus can be reduced by, e.g., heat treatment to which adenovirus is more sensitive than AAV.

In an embodiment, the viral vector has the ability of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibody, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas 9 and gRNA) in only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutin (HA) can be incorporated to increase viral uptake into cells. In an embodiment, the viral vector has the ability of nuclear localization. For example, a virus that requires the breakdown of the cell wall (during cell division) and therefore will not infect a non-diving cell can be altered to incorporate a nuclear localization peptide in the matrix protein of the virus thereby enabling the transduction of non-proliferating cells. In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, gene gun, sonoporation, magnetofection, lipid-mediated transfection, dendrimers, inorganic nanoparticles, calcium phosphates, or a combination thereof.

In some embodiments, the Cas9- and/or gRNA-encoding DNA is delivered by a combination of a vector and a non-vector based method. For example, a virosome comprises a liposome combined with an inactivated virus (e.g., HIV or influenza virus), which can result in more efficient gene transfer, e.g., in a respiratory epithelial cell than either a viral or a liposomal method alone.

In an embodiment, the delivery vehicle is a non-viral vector. In an embodiment, the non-viral vector is an inorganic nanoparticle. Exemplary inorganic nanoparticles include, e.g., magnetic nanoparticles (e.g., $Fe_3MnO_2$) and silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 20.

TABLE 20

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |

TABLE 20-continued

Lipids Used for Gene Transfer

| Lipid | Abbreviation | Feature |
|---|---|---|
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 21.

TABLE 21

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars, and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacteriumlongum*, and modified *Escherichia coli*), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovescicle (30-100 nm) of endocytic origin (e.g., can be produced from various cell types and can therefore be taken up by cells without the need of for targeting ligands).

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein.

Delivery of RNA Encoding a Cas9 Molecule

RNA encoding Cas9 molecules (e.g., eaCas9 molecules) and/or gRNA molecules, can be delivered into cells, e.g., target cells described herein, by art-known methods or as described herein. For example, Cas9-encoding and/or gRNA-encoding RNA can be delivered, e.g., by microinjection, electroporation, lipid-mediated transfection, peptide-mediated delivery, or a combination thereof. Cas9-encoding and/or gRNA-encoding RNA can be conjugated to molecules (e.g., GalNAc) promoting uptake by the target cells (e.g., target cells described herein).

Delivery Cas9 Molecule Protein

Cas9 molecules (e.g., eaCas9 molecules) can be delivered into cells by art-known methods or as described herein. For example, Cas9 protein molecules can be delivered, e.g., by microinjection, electroporation, lipid-mediated transfection, peptide-mediated delivery, or a combination thereof. Delivery can be accompanied by DNA encoding a gRNA or by a gRNA. Cas9-encoding and/or gRNA-encoding RNA can be conjugated to molecules (e.g., GalNAc) promoting uptake by the target cells (e.g., target cells described herein).

Route of Administration

Systemic modes of administration include oral and parenteral routes. Parenteral routes include, by way of example, intravenous, intrarterial, intramuscular, intradermal, subcutaneous, intranasal and intraperitoneal routes. Components administered systemically may be modified or formulated to target the components to the eye.

Local modes of administration include, by way of example, intraocular, intraorbital, subconjuctival, intravitreal, subretinal or transscleral routes. In an embodiment, significantly smaller amounts of the components (compared with systemic approaches) may exert an effect when administered locally (for example, intravitreally) compared to when administered systemically (for example, intravenously). Local modes of administration can reduce or eliminate the incidence of potentially toxic side effects that may occur when therapeutically effective amounts of a component are administered systemically.

In an embodiment, components described herein are delivered subretinally, e.g., by subretinal injection. Subretinal injections may be made directly into the macular, e.g., submacular injection.

In an embodiment, components described herein are delivered by intravitreal injection. Intravitreal injection has a relatively low risk of retinal detachment. In an embodiment, nanoparticle or viral, e.g., AAV vector, is delivered intravitreally.

Methods for administration of agents to the eye are known in the medical arts and can be used to administer components described herein. Exemplary methods include intraocular injection (e.g., retrobulbar, subretinal, submacular, intravitreal and intrachoridal), iontophoresis, eye drops, and intraocular implantation (e.g., intravitreal, sub-Tenons and sub-conjunctival).

Administration may be provided as a periodic bolus (for example, subretinally, intravenously or intravitreally) or as continuous infusion from an internal reservoir (for example, from an implant disposed at an intra- or extra-ocular location (see, U.S. Pat. Nos. 5,443,505 and 5,766,242)) or from an external reservoir (for example, from an intravenous bag). Components may be administered locally, for example, by continuous release from a sustained release drug delivery device immobilized to an inner wall of the eye or via targeted transscleral controlled release into the choroid (see, for example, PCT/US00/00207, PCT/US02/14279, Ambati et al. (2000) INVEST. OPHTHALMOL. VIS. SCI. 41:1181-1185, and Ambati et al. (2000) INVEST. OPHTHALMOL. VIS. SCI.41:1186-1191). A variety of devices suitable for administering components locally to the inside of the eye are known in the art. See, for example, U.S. Pat. Nos. 6,251,090, 6,299,895, 6,416,777, 6,413,540, and PCT/US00/28187.

In addition, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly (caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly (ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly (vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used for intraocular injection. Typically the microspheres are composed of a polymer of lactic acid and glycolic acid, which are structured to form hollow spheres. The spheres can be approximately 15-30 microns in diameter and can be loaded with components described herein.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety.

In an embodiment, the Cas9 molecule and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, gRNA molecule, template nucleic acid, or payload. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In an embodiment, a gRNA molecule can be delivered by such modes. The Cas9 molecule component can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmacokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. E.g., the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

Ex Vivo Delivery

In some embodiments, components described in Table 17 are introduced into cells which are then introduced into the subject. Methods of introducing the components can include, e.g., any of the delivery methods described in Table 18.

VIII. Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose sugar, e.g., of the 2' hydroxyl on the ribose sugar;

(iii) wholesale replacement of the phosphate moiety with "dephospho" linkers;

(iv) modification or replacement of a naturally occurring nucleobase;

(v) replacement or modification of the ribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA is modified, e.g., all bases have a modified phosphate group, e.g., all are phosphorothioate groups. In an embodiment, all, or substantially all, of the phosphate groups of a unimolecular or modular gRNA molecule are replaced with phosphorothioate groups.

In an embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications

The Phosphate Group

In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), ($OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm⁵s2U), 5-methylaminomethyl-2-seleno-uridine (mnm⁵se²U), 5-carbamoylmethyl-uridine (ncm⁵U), 5-carboxymethylaminomethyl-uridine (cmnm⁵U), 5-carboxymethylaminomethyl-2-thio-uridine (cmnm⁵s2U), 5-propynyl-uridine, 1-propynyl-pseudouridine, 5-taurinomethyl-uridine (τcm⁵U), 1-taurinomethyl-pseudouridine, 5-taurinomethyl-2-thio-uridine(τm⁵s2U), 1-taurinomethyl-4-thio-pseudouridine, 5-methyl-uridine (m⁵U, i.e., having the nucleobase deoxythymine), 1-methyl-pseudouridine (m¹ψ), 5-methyl-2-thio-uridine (m⁵s2U), 1-methyl-4-thio-pseudouridine (m¹s⁴ψ), 4-thio-1-methyl-pseudouridine, 3-methyl-pseudouridine (m³ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m⁵D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl)uridine (acp³U), 1-methyl-3-(3-amino-3-carboxypropyl)pseudouridine (acp³ψ), 5-(isopentenylaminomethyl)uridine (inm⁵U), 5-(isopentenylaminomethyl)-2-thio-uridine (inm⁵s2U), α-thio-uridine, 2'-O-methyl-uridine (Um), 5,2'-O-dimethyl-uridine (m⁵Um), 2'-O-methyl-pseudouridine (ψm), 2-thio-2'-O-methyl-uridine (s2Um), 5-methoxycarbonylmethyl-2'-O-methyl-uridine (mcm⁵Um), 5-carbamoylmethyl-2'-O-methyl-uridine (ncm⁵Um), 5-carboxymethylaminomethyl-2'-O-methyl-uridine (cmnm⁵Um), 3,2'-O-dimethyl-uridine (m³Um), 5-(isopentenylaminomethyl)-2'-O-methyl-uridine (inm⁵Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m³C), N4-acetyl-cytidine (act), 5-formyl-cytidine (f⁵C), N4-methyl-cytidine (m⁴C), 5-methyl-cytidine (m⁵C), 5-halo-cytidine (e.g., 5-iodo-cytidine), 5-hydroxymethyl-cytidine (hm⁵C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k²C), α-thio-cytidine, 2'-O-methyl-cytidine (Cm), 5,2'-O-dimethyl-cytidine (m⁵Cm), N4-acetyl-2'-O-methyl-cytidine (ac⁴Cm), N4,2'-O-dimethyl-cytidine (m⁴Cm), 5-formyl-2'-O-methyl-cytidine (f⁵Cm), N4,N4,2'-O-trimethyl-cytidine (m⁴₂Cm), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m¹A), 2-methyl-adenine (m²A), N6-methyl-adenosine (m⁶A), 2-methylthio-N6-methyl-adenosine (ms2 m⁶A), N6-isopentenyl-adenosine (i⁶A), 2-methylthio-N6-isopentenyl-adenosine (ms²i⁶A), N6-(cis-hydroxyisopentenyl)adenosine (io⁶A), 2-methylthio-N6-(cis-hydroxyisopentenyl)adenosine (ms2io⁶A), N6-glycinylcarbamoyl-adenosine (g⁶A), N6-threonylcarbamoyl-adenosine (t⁶A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m⁶₂A), N6-hydroxynorvalylcarbamoyl-adenosine (hn⁶A), 2-methylthio-N6-hydroxynorvalylcarbamoyl-adenosine (ms2hn⁶A), N6-acetyl-adenosine (ac⁶A), 7-methyl-adenine, 2-methylthio-adenine, 2-methoxy-adenine, α-thio-adenosine, 2'-O-methyl-adenosine (Am), N⁶,2'-O-dimethyl-adenosine (m⁶Am), N⁶-Methyl-2'-deoxyadenosine, N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ₀), 7-aminomethyl-7-deaza-guanosine (preQi), archaeosine (G⁺), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m'G), N2-methyl-guanosine (m²G), N2,N2-dimethyl-guanosine (m²₂G), N2,7-dimethyl-guanosine (m²,7G), N2,N2,7-dimethyl-guanosine (m²,2,7G), 8-oxo-guanosine, 7-methyl-8-oxo-guanosine, 1-meth thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m'Gm), N2,7-dimethyl-2'-O-methyl-guanosine (m²,7Gm), 2'-O-methyl-inosine (Im), 1,2'-O-dimethyl-inosine (m'Im), O⁶-phenyl-2'-deoxyinosine, 2'-O-ribosylguanosine (phosphate) (Gr(p)), 1-thio-guanosine, O⁶-methyl-guanosine, O⁶-Methyl-2'-deoxyguanosine, 2'-F-ara-guanosine, and 2'-F-guanosine.

Modified gRNAs

In some embodiments, the modified nucleic acids can be modified gRNAs. In some embodiments, gRNAs can be modified at the 3' end. In this embodiment, the gRNAs can be modified at the 3' terminal U ribose. For example, the two terminal hydroxyl groups of the U ribose can be oxidized to aldehyde groups and a concomitant opening of the ribose ring to afford a modified nucleoside as sown below:

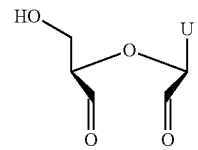

wherein "U" can be an unmodified or modified uridine.

In another embodiment, the 3' terminal U can be modified with a 2'3' cyclic phosphate as shown below:

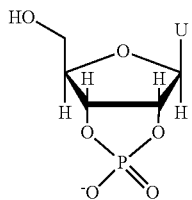

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the gRNA. In some embodiments, O- and N-alkylated nucleotides, e.g., N6-methyl andenosine, can be incorporated into the gRNA. In some embodiments, sugar-modified ribonucleotides can be incorporated, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the nucleotides in the overhang region of the gRNA can each independently be a modified or unmodified nucleotide including, but not limited to 2'-sugar modified, such as, 2-F 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In an embodiment, one or more or all of the nucleotides in single stranded RNA molecule, e.g., a gRNA molecule, are deoxynucleotides.

miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory, in an embodiment, it is believed that the down regulation is either by reducing nucleic acid molecule stability or by inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

Governing gRNA Molecules and the Use Thereof to Limit the Activity of a Cas9 System Methods and compositions that use, or include, a nucleic acid, e.g., DNA, that encodes a Cas9 molecule or a gRNA molecule, can, in addition, use or include a "governing gRNA molecule." The governing gRNA can limit the activity of the other CRISPR/Cas components introduced into a cell or subject. In an embodiment, a gRNA molecule comprises a targeting domain that is complementary to a target domain on a nucleic acid that comprises a sequence that encodes a component of the CRISPR/Cas system that is introduced into a cell or subject. In an embodiment, a governing gRNA molecule comprises a targeting domain that is complementary with a target sequence on: (a) a nucleic acid that encodes a Cas9 molecule; (b) a nucleic acid that encodes a gRNA which comprises a targeting domain that targets the CEP290 gene (a target gene gRNA); or on more than one nucleic acid that encodes a CRISPR/Cas component, e.g., both (a) and (b). The governing gRNA molecule can complex with the Cas9 molecule to inactivate a component of the system. In an embodiment, a Cas9 molecule/governing gRNA molecule complex inactivates a nucleic acid that comprises the sequence encoding the Cas9 molecule. In an embodiment, a Cas9 molecule/governing gRNA molecule complex inactivates the nucleic acid that comprises the sequence encoding a target gene gRNA molecule. In an embodiment, a Cas9 molecule/governing gRNA molecule complex places temporal, level of expression, or other limits, on activity of the Cas9 molecule/target gene gRNA molecule complex. In an embodiment, a Cas9 molecule/governing gRNA molecule complex reduces off-target or other unwanted activity. In an embodiment, a governing gRNA molecule targets the coding sequence, or a control region, e.g., a promoter, for the CRISPR/Cas system component to be negatively regulated. For example, a governing gRNA can target the coding sequence for a Cas9 molecule, or a control region, e.g., a promoter, that regulates the expression of the Cas9 molecule coding sequence, or a sequence disposed between the two. In an embodiment, a governing gRNA molecule targets the coding sequence, or a control region, e.g., a promoter, for a target gene gRNA. In an embodiment, a governing gRNA, e.g., a Cas9-targeting or target gene gRNA-targeting, governing gRNA molecule, or a nucleic acid that encodes it, is introduced separately, e.g., later, than is the Cas9 molecule or a nucleic acid that encodes it. For example, a first vector, e.g., a viral vector, e.g., an AAV vector, can introduce nucleic acid encoding a Cas9 molecule and one or more target gene gRNA molecules, and a second vector, e.g., a viral vector, e.g., an AAV vector, can introduce nucleic acid encoding a governing gRNA molecule, e.g., a Cas9-targeting or target gene gRNA targeting, gRNA molecule. In an embodiment, the second vector can be introduced after the first. In other embodiments, a governing gRNA molecule, e.g., a Cas9-targeting or target gene gRNA targeting, governing gRNA molecule, or a nucleic acid that encodes it, can be introduced together, e.g., at the same time or in the same vector, with the Cas9 molecule or a nucleic acid that encodes it, but, e.g., under transcriptional control elements, e.g., a promoter or an enhancer, that are activated at a later time, e.g., such that after a period of time the transcription of Cas9 is reduced. In an embodiment, the transcriptional control element is activated intrinsically. In an embodiment, the transcriptional element is activated via the introduction of an external trigger.

Typically a nucleic acid sequence encoding a governing gRNA molecule, e.g., a Cas9-targeting gRNA molecule, is under the control of a different control region, e.g., promoter, than is the component it negatively modulates, e.g., a nucleic acid encoding a Cas9 molecule. In an embodiment, "different control region" refers to simply not being under the control of one control region, e.g., promoter, that is functionally coupled to both controlled sequences. In an embodiment, different refers to "different control region" in kind or type of control region. For example, the sequence encoding a governing gRNA molecule, e.g., a Cas9-targeting gRNA molecule, is under the control of a control region, e.g., a promoter, that has a lower level of expression, or is expressed later than the sequence which encodes is the component it negatively modulates, e.g., a nucleic acid encoding a Cas9 molecule.

By way of example, a sequence that encodes a governing gRNA molecule, e.g., a Cas9-targeting governing gRNA molecule, can be under the control of a control region (e.g., a promoter) described herein, e.g., human U6 small nuclear promoter, or human H1 promoter. In an embodiment, a sequence that encodes the component it negatively regulates, e.g., a nucleic acid encoding a Cas9 molecule, can be under the control of a control region (e.g., a promoter) described herein, e.g., CMV, EF-1a, MSCV, PGK, CAG control promoters.

EXAMPLES

The following Examples are merely illustrative and are not intended to limit the scope or content of the invention in any way.

Example 1: Cloning and Initial Screening of gRNAs

The suitability of candidate gRNAs can be evaluated as described in this example.

Although described for a chimeric gRNA, the approach can also be used to evaluate modular gRNAs.

Cloning gRNAs into Plasmid Vector

For each gRNA, a pair of overlapping oligonucleotides is designed and obtained. Oligonucleotides are annealed and ligated into a digested vector backbone containing an upstream U6 promoter and the remaining sequence of a long chimeric gRNA. Plasmid is sequence-verified and prepped to generate sufficient amounts of transfection-quality DNA. Alternate promoters may be used to drive in vivo transcription (e.g. H1 promoter) or for in vitro transcription (eg. T7 promoter).

Cloning gRNAs in Linear dsDNA Molecule (STITCHR)

For each gRNA, a single oligonucleotide is designed and obtained. The U6 promoter and the gRNA scaffold (e.g. including everything except the targeting domain, e.g., including sequences derived from the crRNA and tracrRNA, e.g., including a first complementarity domain; a linking domain; a second complementarity domain; a proximal domain; and a tail domain) are separately PCR amplified and purified as dsDNA molecules. The gRNA-specific oligonucleotide is used in a PCR reaction to stitch together the U6 and the gRNA scaffold, linked by the targeting domain specified in the oligonucleotide. Resulting dsDNA molecule (STITCHR product) is purified for transfection. Alternate promoters may be used to drive in vivo transcription (e.g., H1 promoter) or for in vitro transcription (e.g., T7 promoter). Any gRNA scaffold may be used to create gRNAs compatible with Cas9s from any bacterial species.

Initial gRNA Screen

Each gRNA to be tested is transfected, along with a plasmid expressing Cas9 and a small amount of a GFP-expressing plasmid into human cells. In preliminary experiments, these cells can be immortalized human cell lines such as 293T, K562 or U20S. Alternatively, primary human cells may be used. In this case, cells may be relevant to the eventual therapeutic cell target (for example, photoreceptor cells). The use of primary cells similar to the potential therapeutic target cell population may provide important information on gene targeting rates in the context of endogenous chromatin and gene expression.

Transfection may be performed using lipid transfection (such as Lipofectamine or Fugene) or by electroporation. Following transfection, GFP expression can be determined either by fluorescence microscopy or by flow cytometry to confirm consistent and high levels of transfection. These preliminary transfections can comprise different gRNAs and different targeting approaches (17-mers, 20-mers, nuclease, dual-nickase, etc.) to determine which gRNAs/combinations of gRNAs give the greatest activity.

Efficiency of cleavage with each gRNA may be assessed by measuring NHEJ-induced indel formation at the target locus by a T7E1-type assay or by sequencing. Alternatively, other mismatch-sensitive enzymes, such as Cell/Surveyor nuclease, may also be used.

For the T7E1 assay, PCR amplicons are approximately 500-700 bp with the intended cut site placed asymmetrically in the amplicon. Following amplification, purification and size-verification of PCR products, DNA is denatured and re-hybridized by heating to 95° C. and then slowly cooling. Hybridized PCR products are then digested with T7 Endonuclease I (or other mismatch-sensitive enzyme) which recognizes and cleaves non-perfectly matched DNA. If indels are present in the original template DNA, when the amplicons are denatured and re-annealed, this results in the hybridization of DNA strands harboring different indels and therefore lead to double-stranded DNA that is not perfectly matched. Digestion products may be visualized by gel electrophoresis or by capillary electrophoresis. The fraction of DNA that is cleaved (density of cleavage products divided by the density of cleaved and uncleaved) may be used to estimate a percent NHEJ using the following equation: % NHEJ=$(1-(1-\text{fraction cleaved})^{1/2})$. The T7E1 assay is sensitive down to about 2-5% NHEJ.

Sequencing may be used instead of, or in addition to, the T7E1 assay. For Sanger sequencing, purified PCR amplicons are cloned into a plasmid backbone, transformed, miniprepped and sequenced with a single primer. For large sequencing numbers, Sanger sequencing may be used for determining the exact nature of indels after determining the NHEJ rate by T7E1.

Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low NHEJ rates.

Example 2: Assessment of Gene Targeting by NHEJ

The gRNAs that induce the greatest levels of NHEJ in initial tests can be selected for further evaluation of gene targeting efficiency. For example, cells may be derived from disease subjects, relevant cell lines, and/or animal models and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency to generate the desired mutations (either knockout of a target gene or removal of a target sequence motif) may be determined by sequencing. For Sanger sequencing, PCR amplicons may be 500-700 bp long. For next generation sequencing, PCR amplicons may be 300-500 bp long. If the goal is to knockout gene function, sequencing may be used to assess what percent of alleles have undergone NHEJ-induced indels that result in a frameshift or large deletion or insertion that would be expected to destroy gene function. If the goal is to remove a specific sequence motif, sequencing may be used to assess what percent of alleles have undergone NHEJ-induced deletions that span this sequence.

Example 3: Assessment of Activity of Individual gRNAs Targeting CEP290

Figure 11A:
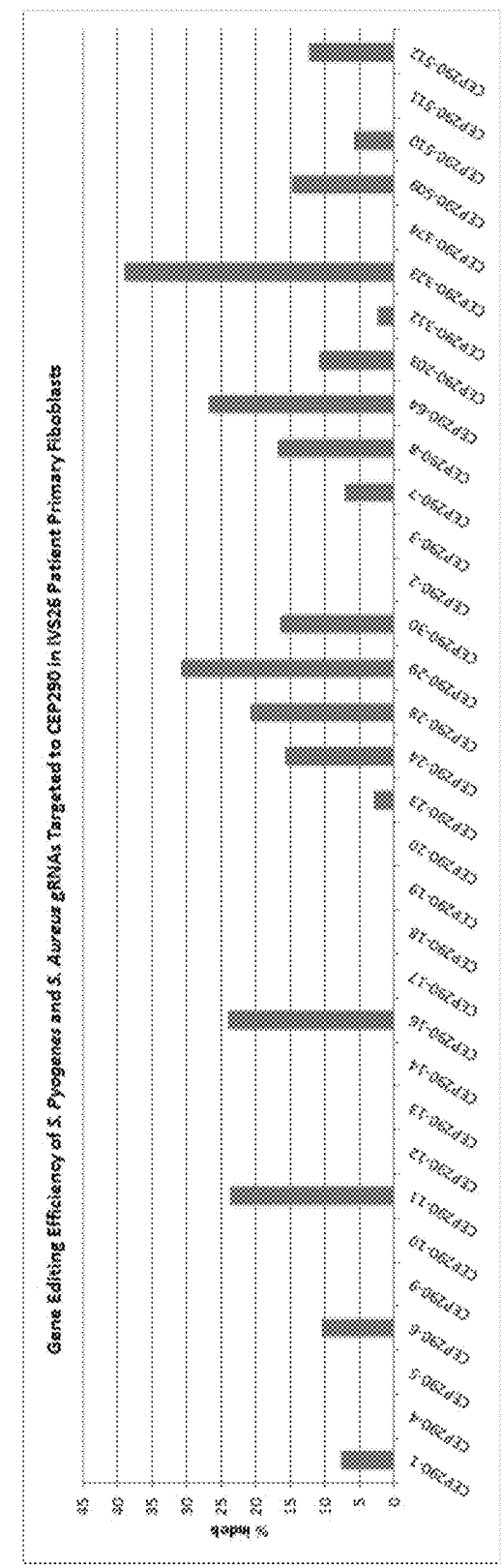
FIGS. 11A-11B show the rates of indels induced by various gRNAs at the CEP290 locus.
Figure 11B:
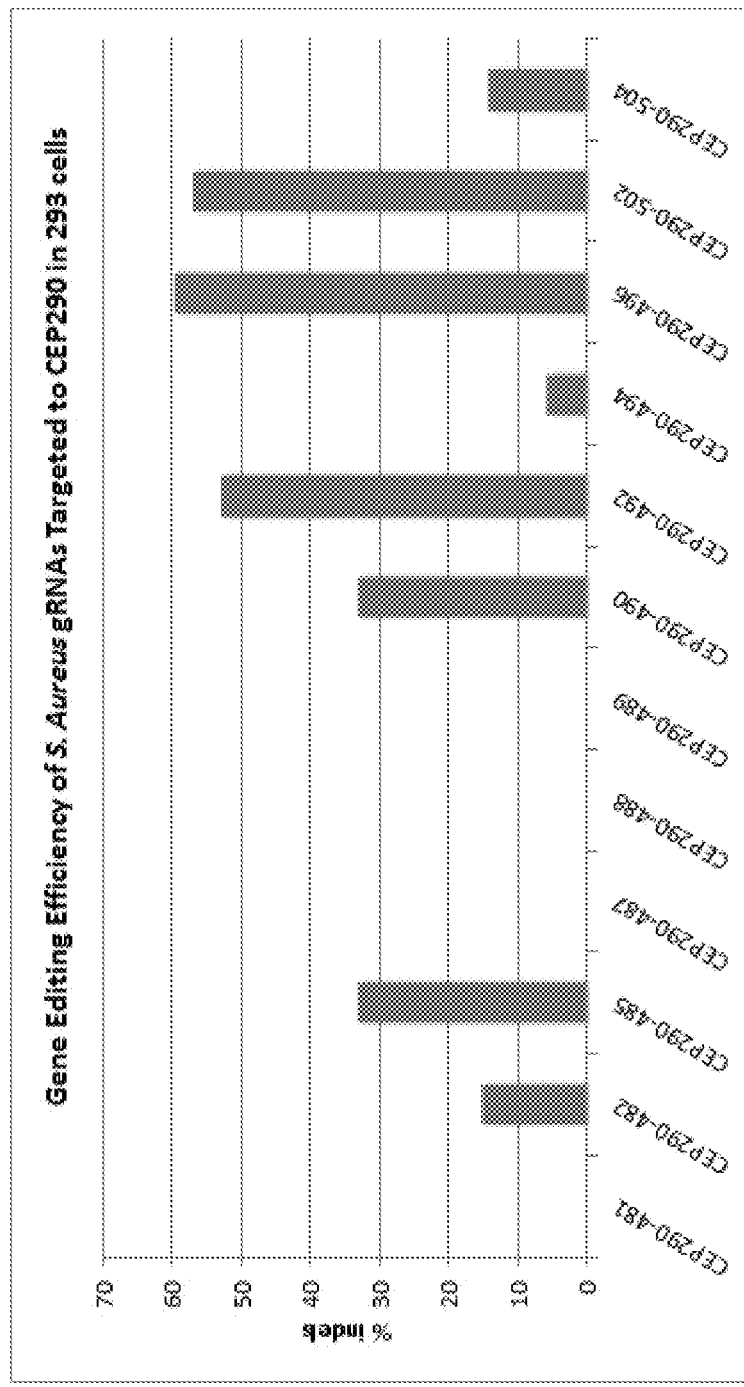

Guide RNA were identified using a custom guide RNA design software based on the public tool cas-offinder (Bae et al. Bioinformatics. 2014; 30(10): 1473-1475). Each gRNA to be tested was generated as a STITCHR product and co-transfected with a plasmid expressing either *S. aureus* Cas9 (pAF003) or *S. pyogenes* Cas9 (pJDS246) into either HEK293 cells or primary fibroblasts derived from and LCA10 patient harboring homozygous IVS26 c.2991+ 1655A to G mutations (hereafter referred to as IVS26 fibroblasts). The pAF003 plasmid encodes the *S. aureus* Cas9, with N-terminal and C-terminal nuclear localization signals (NLS) and a C-terminal triple flag tag, driven by a CMV promoter. The pJDS246 plasmid encodes the *S. pyogenes* Cas9, with a C-terminal nuclear localization signal (NLS) and a C-terminal triple flag tag, driven by a CMV promoter. gRNA and Cas9-encoding DNA was introduced into cells by either Mirus TransIT-293 transfection reagent (for 293 cells) or by Amaxa nucleofection (for IVS26 fibroblasts). Nucleofection was optimized for transfection of IVS26 fibroblasts using solution P2 and various pulse codes and assaying for highest levels of gene editing and cell viability. Transfection efficiency in both cell types was assessed by transfecting with GFP and assaying expression by fluorescent microscopy. Three to seven days post-transfection, genomic DNA was isolated from bulk populations of transfected cells and the region of the CEP290 locus surrounding the target site was PCR amplified. PCR amplicons were then cloned into a plasmid backbone using the Zero-Blunt TOPO cloning kit (Lifetechnologies) and transformed into chemically competent Top10 cells. Bacterial colonies were then cultured and plasmid DNA was isolated and sequenced. Sequencing of PCR products allowed for the detection and quantification of targeted insertion and deletion (indel) events at the target site. FIGS. 11A and 11B show the rates of indels induced by various gRNAs at the CEP290 locus. FIG. 11A shows gene editing (% indels) as assessed by sequencing for *S. pyogenes* and *S. aureus* gRNAs when co-expressed with Cas9 in patient-derived IVS26 primary fibroblasts. FIG. 11B shows gene editing (% indels) as assessed by sequencing for *S. aureus* gRNAs when co-expressed with Cas9 in HEK293 cells.

Example 4: Detection of gRNA Pair-Induced Deletions by PCR

To assess the ability of a pair of gRNAs to induce a genomic deletion (in which the sequence between the two cut sites is removed), PCR was performed across the predicted deletion. Pairs of gRNAs (encoded as STITCHR products) were co-transfected with pAF003 into IVS26 fibroblasts. Genomic DNA was isolated from transfected cells and PCR was performed to amplify a segment of the CEP290 locus spanning the two predicted cut sites. PCR was run on a QIAxcel capillary electrophoresis machine. The predicted amplicon on a wildtype allele is 1816 bps. Assuming that cleavage occurs within the gRNA target region, amplicon sizes for alleles having undergone the deletion event were calculated and the presence of this smaller band indicates that the desired genomic deletion event has occurred (Table 22).

TABLE 22

| | Left gRNA | Right gRNA | Deletion Size | Amplicon with deletion | Deletion amplicon detected? |
|---|---|---|---|---|---|
| 1 | CEP290-367 | CEP290-16 | 590 | 1226 | no |
| 2 | CEP290-367 | CEP290-203 | 688 | 1128 | no |
| 3 | CEP290-367 | CEP290-132 | 815 | 1001 | no |
| 4 | CEP290-367 | CEP290-139 | 1265 | 551 | no |
| 5 | CEP290-312 | CEP290-11 | 790 | 1026 | yes |
| 6 | CEP290-312 | CEP290-252 | 973 | 843 | no |
| 7 | CEP290-312 | CEP290-64 | 976 | 840 | yes |
| 8 | CEP290-312 | CEP290-230 | 1409 | 407 | yes |
| 9 | CEP290-12 | CEP290-11 | 19 | 1797 | no |
| 10 | CEP290-12 | CEP290-252 | 202 | 1614 | no |
| 11 | CEP290-12 | CEP290-64 | 205 | 1611 | no |
| 12 | CEP290-12 | CEP290-230 | 638 | 1178 | no |
| 13 | CEP290-17 | CEP290-16 | 19 | 1797 | no |
| 14 | CEP290-17 | CEP290-203 | 117 | 1699 | no |
| 15 | CEP290-17 | CEP290-132 | 244 | 1572 | no |
| 16 | CEP290-17 | CEP290-139 | 693 | 1123 | no |
| 17 | CEP290-374 | CEP290-16 | 799 | 1017 | no |
| 18 | CEP290-374 | CEP290-203 | 897 | 919 | no |
| 19 | CEP290-374 | CEP290-132 | 1024 | 792 | no |
| 20 | CEP290-374 | CEP290-139 | 1473 | 343 | no |
| 21 | CEP290-368 | CEP290-16 | 854 | 962 | no |
| 22 | CEP290-368 | CEP290-203 | 952 | 864 | no |
| 23 | CEP290-368 | CEP290-132 | 1079 | 737 | no |
| 24 | CEP290-368 | CEP290-139 | 1528 | 288 | no |
| 25 | CEP290-323 | CEP290-11 | 990 | 826 | yes |
| 26 | CEP290-323 | CEP290-252 | 1173 | 643 | no |
| 27 | CEP290-323 | CEP290-64 | 1176 | 640 | yes |
| 28 | CEP290-323 | CEP290-230 | 1609 | 207 | yes |
| 29 | Cas9 only | | | wt amplicon = 1816 | no |
| 30 | GFP only | | | wt amplicon = 1816 | no |
| 31 | no DNA PCR neg ctrl | | | | |

Example 5: Gene Expression Analysis of CEP290

Figure 12A:
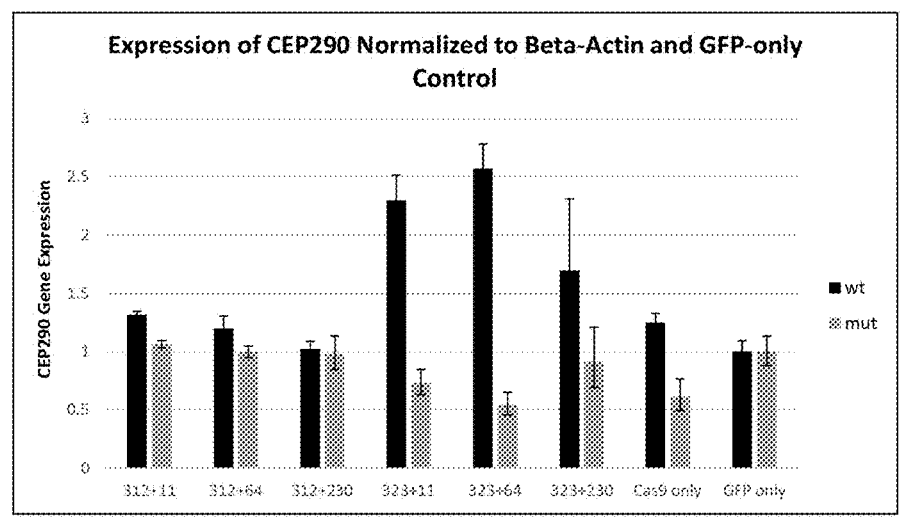
FIGS. 12A-12B show changes in expression of the wild-type and mutant (including cryptic exon) alleles of CEP290 in cells transfected with Cas9 and the indicated gRNA pairs. Total RNA was isolated from modified cells and qRT-PCR with Taqman primer-probe sets was used to quantify expression. Expression is normalized to the Beta-Actin housekeeping gene and each sample is normalized to the GFP control sample (cells transfected with only GFP). Error bars represent standard deviation of 4 technical replicates.
Figure 12B:
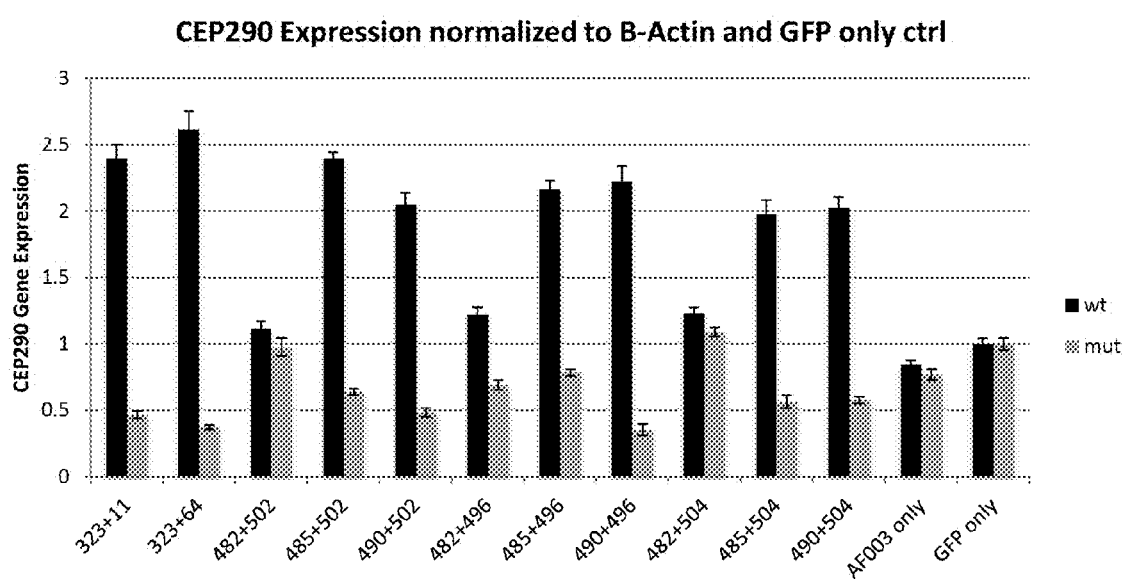
Figure 13:
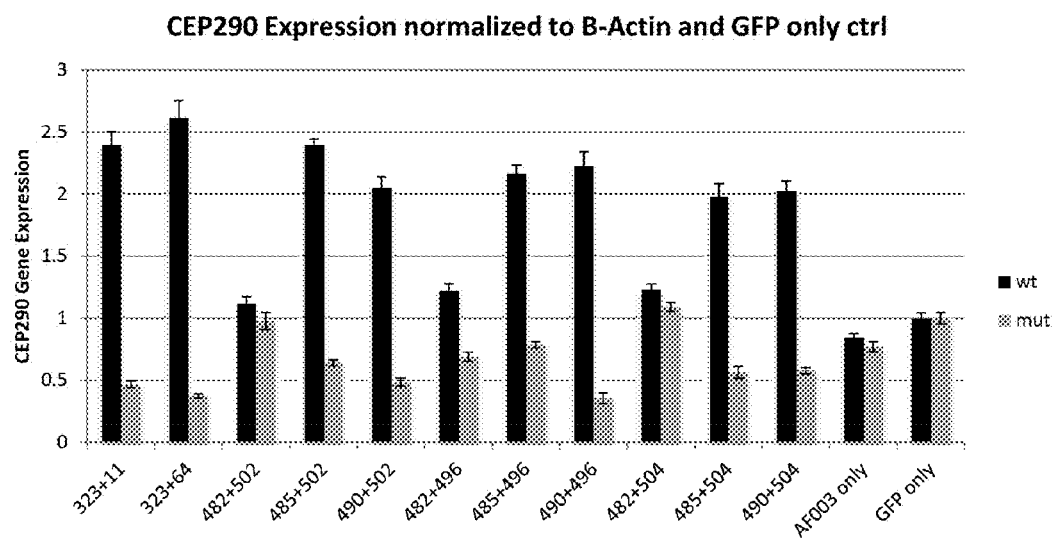
FIG. 13 shows changes in gene expression of the wildtype and mutant (including cryptic exon) alleles of CEP290 in cells transfected with Cas9 and pairs of gRNAs shown to have in initial qRT-PCR screening. Total RNA was isolated from modified cells and qRT-PCR with Taqman primer-probe sets was used to quantify expression. Expression is normalized to the Beta-Actin housekeeping gene and each sample is normalized to the GFP control sample (cells transfected with only GFP). Error bars represent standard error of the mean of two to six biological replicates.

Targeted deletion of a region containing the IVS26 splice mutation is predicted to correct the splicing defect and restore expression of the normal wild-type CEP290 allele. To quantify expression of the wild-type and mutant (containing additional cryptic splice mutation) alleles, TaqMan assays were designed. Multiple assays were tested for each RNA species and a single wt and single mutant assay were selected. The assay for the wild-type allele contains a forward primer that anneals in exon 26, a reverse primer that anneals in exon 27 and a TaqMan probe that spans the exon26-exon-27 junction. The assay for the mutant allele contains a forward primer that anneals in exon 26, a reverse primer that anneals in the cryptic exon and a TaqMan probe that spans the exon26-cryptic exon junction. A TaqMan assay designed to beta-actin was used as a control. Total RNA was isolated from IVS26 cells transfected with pairs of gRNAs and Cas9-expressing plasmid by either Trizol RNA purification (Ambion), Agencourt RNAdvance (Beckman Coulter) or direct cells-to-Ct lysis (Lifetechnologies). Reverse transcription to generate cDNA was performed and cDNA was used as a template for qRT-PCR using selected taqman assays on a BioRad real time PCR machine. Relative gene expression was calculated by AACt, relative to beta-actin control and GFP-only sample. Increases in expression of wt allele and decreases in expression of mutant allele relative to GFP-only control indicate corrected splicing due to gene targeting. FIGS. 12A-12B show initial qRT-PCR data for pairs of gRNAs that had shown activity as either individual gRNAs (measured as described in Example 3) or as pairs (measured as described in Example 4). Pairs of gRNAs that showed the desired gene expression changes were repeated in replicate experiments and the cumulative qRT-PCR data is shown in FIG. 13 (error bars represent standard error of the mean calculated from 2 to 6 biological replicates per sample).

Example 6: Quantification of Genomic Deletions by ddPCR

Figure 14:
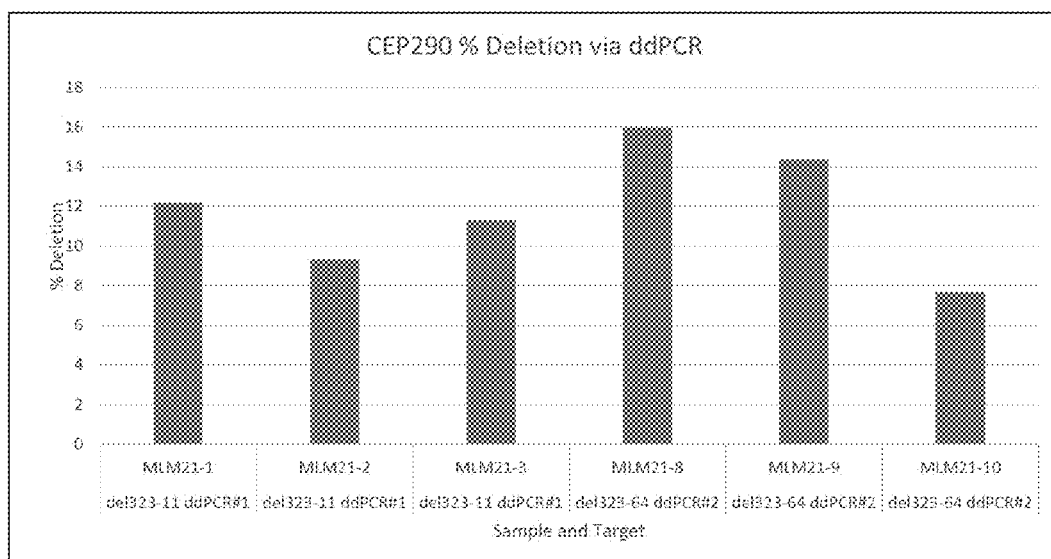
FIG. 14 shows deletion rates in cells transfected with indicated gRNA pairs and Cas9 as measured by droplet digital PCR (ddPCR). % deletion was calculated by dividing the number of positive droplets in deletion assay by the number of positive droplets in a control assay. Three biological replicates are shown for two different gRNA pairs.

Droplet digital PCR (ddPCR) is a method for performing digital PCR in which a single PCR reaction is fractionated into 20,000 droplets in a water-oil emulsion and PCR amplification occurs separately in individual droplets. PCR conditions are optimized for a concentration of DNA template such that each droplet contains either one or no template molecules. Assays were designed to perform amplification using BioRad EvaGreen Supermix PCR system with all amplicons ranging in size from 250-350 bp. Control assays were designed to amplify segments of the CEP290 gene at least 5 kb away from the IVS26 c.2991+1655A to G mutation. Assays to detect targeted genomic deletion were designed such that amplification of an allele that has undergone deletion will yield a PCR product in the size range of 250-350 bp and amplification will not occur on a wild-type allele due to the increased distance between forward and reverse primers. PCR conditions were optimized on genomic DNA isolated from 293 cells that had been transfected with pairs of gRNAs and Cas9-expressing plasmid. Deletion assays were verified to generate no positive signal on genomic DNA isolated from unmodified IVS26 fibroblasts. Assays were further tested and optimized on genomic DNA isolated from IVS26 fibroblasts that had been transfected with pairs of gRNAs and Cas9-encoding plasmid. Of the three assays tested for each of two deletions (CEP290-323 and CEP290-11; and CEP290-323 and CEP290-64) and the 4 control assays tested, a single assay was selected for each deletion and a control based on quality data and replicability in the ddPCR assay. FIG. 14 shows deletion rates on three biological replicates calculated by taking the number of positive droplets for the deletion assay and dividing by the number of positive droplets for the control assay.

Example 7: Cloning AAV Expression Vectors

Cloning saCas9 into an AAV Expression Vector

The pAF003 plasmid encodes the CMV-driven *S. aureus* Cas9 (saCas9), with N-terminal and C-terminal nuclear localization signals (NLS) and a C-terminal triple flag tag, followed by a bovine growth hormone poly(A) tail (bGH polyA). BGH polyA tail was substituted with a 60-bp minimal polyA tail to obtain pAF003-minimal-pA. The CMV-driven NLS-saCas9-NLS-3×Flag with the minimal polyA tail was amplified with PCR and subcloned into pTR-UF11 plasmid (ATCC #MBA-331) with KpnI and SphI sites to obtain the pSS3 (pTR-CMV-saCas9-minimal-pA) vector. The CMV promoter sequence can be substituted with EFS promoter (pSS10 vector), or tissue-specific promoters (Table 19, e.g. photo-receptor-specific promoters, e.g. Human GRK1, CRX, NRL, RCVRN promoters, etc.) using SpeI and NotI sites.

Constructing the all-in-One AAV Expression Vector with One gRNA Sequence

For each individual gRNA sequence, a STITCHR product with a U6 promoter, gRNA, and the gRNA scaffold was obtained by PCR with an oligonucleotide encoding the gRNA sequence. The STITCHR product with one dsDNA molecule of U6-driven gRNA and scaffold was subcloned into pSS3 or pSS10 vectors using KpnI sites flanking the STITCHR product and downstream of the left Inverted Terminal Repeat (ITR) in the AAV vectors. The orientation of the U6-gRNA-scaffold insertion into pSS3 or pSS10 was determined by Sanger sequencing. Alternate promoters may be used to drive gRNA expression (e.g. H1 promoter, 7SK promoter). Any gRNA scaffold sequences compatible with Cas variants from other bacterial species could be incorporated into STITCHR products and the AAV expression vector therein.

Cloning Two gRNA into an AAV Expression Vector

For each pair of gRNA sequences, two ssDNA oligonucleotides were designed and obtained as the STITCHR primers, i.e. the left STITCHR primer and the right STITCHR primer. Two STITCHR PCR reactions (i.e. the left STITCHR PCR and the right STITCHR PCR) amplified the U6 promoter and the gRNA scaffold with the corresponding STITCHR primer separately. The pSS3 or pSS10 backbone was linearized with KpnI restriction digest. Two dsDNA STITCHR products were purified and subcloned into pSS3 or pSS10 backbone with Gibson Assembly. Due to the unique overlapping sequences upstream and downstream of the STITCHR products, the assembly is unidirectional. The sequences of the constructs were confirmed by Sanger Sequencing. Table 23 lists the names and compositions of AAV expression vectors constructed, including the names of gRNAs targeting human CEP290, the promoter to drive Cas9 expression, and the length of the AAV vector including the Inverted Terminal Repeats (ITRs) from wild type AAV2 geome. Alternative promoters (e.g., H1 promoter or 7SK promoter) or gRNA scaffold sequences compatible with any Cas variants could be adapted into this cloning strategy to obtain the corresponding All-in-One AAV expression vectors with two gRNA sequences.

TABLE 23

Components of AAV expression vectors

| Name | Left gRNA | Right gRNA | Promoter of saCas9 | Length including ITRs |
|---|---|---|---|---|
| pSS10 | NA | NA | EFS | 4100 |
| pSS11 | CEP290-64 | CEP290-323 | EFS | 4853 |
| pSS15 | CEP290-64 | NA | EFS | 4491 |
| pSS17 | CEP290-323 | NA | EFS | 4491 |
| pSS30 | CEP290-323 | CEP290-64 | EFS | 4862 |
| pSS31 | CEP290-323 | CEP290-11 | EFS | 4862 |
| pSS32 | CEP290-490 | CEP290-502 | EFS | 4858 |
| pSS33 | CEP290-490 | CEP290-496 | EFS | 4858 |
| pSS34 | CEP290-490 | CEP290-504 | EFS | 4857 |
| pSS35 | CEP290-492 | CEP290-502 | EFS | 4858 |
| pSS36 | CEP290-492 | CEP290-504 | EFS | 4857 |
| pSS3 | NA | NA | CMV | 4454 |
| pSS8 | CEP290-64 | CEP290-323 | CMV | 5207 |
| pSS47 | CEP290-323 | CEP290-64 | CMV | 5216 |

TABLE 23-continued

Components of AAV expression vectors

| Name | Left gRNA | Right gRNA | Promoter of saCas9 | Length including ITRs |
|---|---|---|---|---|
| pSS48 | CEP290-323 | CEP290-11 | CMV | 5216 |
| pSS49 | CEP290-490 | CEP290-502 | CMV | 5212 |
| pSS50 | CEP290-490 | CEP290-496 | CMV | 5212 |
| pSS51 | CEP290-490 | CEP290-504 | CMV | 5211 |
| pSS52 | CEP290-492 | CEP290-502 | CMV | 5212 |
| pSS53 | CEP290-492 | CEP290-504 | CMV | 5211 |
| pSS23 | NA | NA | hGRK1 | 4140 |
| pSS24 | NA | NA | hCRX | 3961 |
| pSS25 | NA | NA | hNRL | 4129 |
| pSS26 | NA | NA | hRCVRN | 4083 |

Example 8: Assessment of the Functions of all-in-One AAV Expression Vectors

Figure 15:
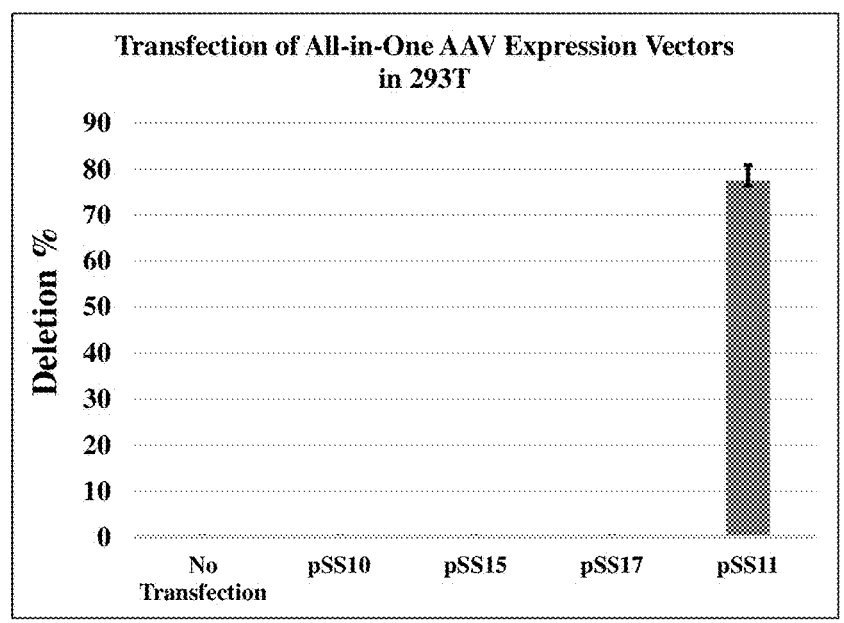
FIG. 15 shows deletion rates in 293T cells transfected with exemplary AAV expression plasmids. pSS10 encodes EFS-driven saCas9 without gRNA. pSS15 and pSS17 encode EFS-driven saCas9 and one U6-driven gRNA, CEP290-64 and CEP290-323 respectively. pSS11 encodes EFS-driven saCas9 and two U6-driven gRNAs, CEP290-64 and CEP290-323 in the same vector. Deletion PCR were performed with gDNA exacted from 293T cells post transfection. The size of the PCR amplicons indicates the presence or absence of deletion events, and the deletion ratio was calculated.

Each individual AAV expression vectors were transfected into 293T cells with TransIT-293 (Mires, Inc.) to test their function before being packaged into AAV viral vectors. 293T cells were transfected with the same amount of plasmid and harvested at the same time points. SaCas9 protein expression was assessed by western blotting with primary antibody probing for the triple Flag tag at the C-terminus of saCas9, while loading control was demonstrated by αTubulin expression. Deletion events at IVS26 mutation could be determined by PCR amplification followed by Sanger sequencing or ddPCR. The results are shown in FIG. 15.

Example 9: Production, Purification and Titering of Recombinant AAV2 Vectors

Figure 16:
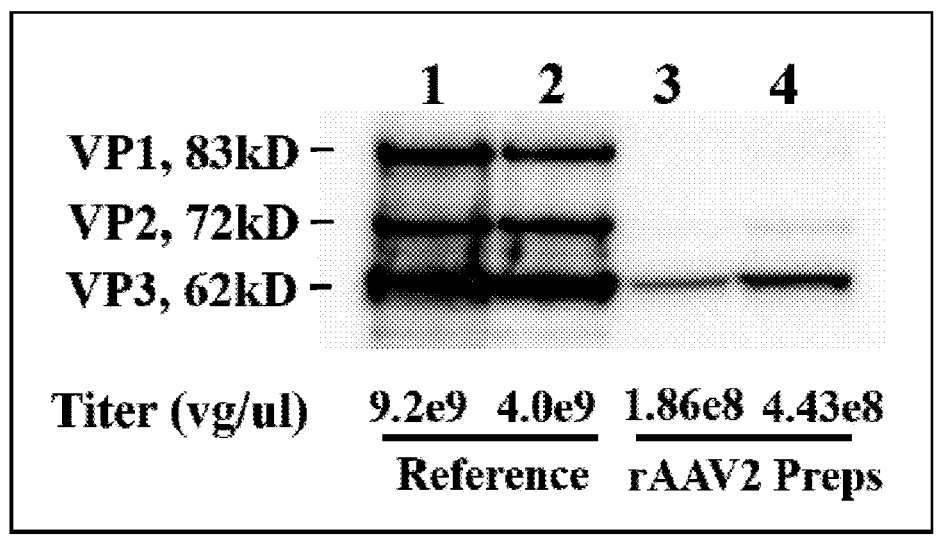
FIG. 16 shows the composition of structural proteins in AAV2 viral preps expressing Cas9. Reference AAV2 vectors (lanes 1 & 2) were obtained from Vector Core at University of North Carolina, Chapel Hill. AAV2-CMV-GFP (lane 3) and AAV2-CMV-saCas9-minpA (lane4) were packaged and purified with "Triple Transfection Protocol" followed by CsCl ultracentrifugation. Titers were obtained by quantitative PCR with primers annealing to the ITR structures on these vectors. Viral preps were denatured and probed with B1 antibody on Western Blots to demonstrate three structural proteins composing AAV2, VP1, VP2, and VP3 respectively.

Prior to packaging into AAV viral vectors, all AAV expression vector (plasmids) underwent primer walk with Sanger sequencing and function analysis. In recombinant AAV (rAAV), two ITRs flanking the transgene cassettes are the only cis-acting elements from the wild-type AAV. They are critical for packaging intact rAAVs and genome-release for rAAV vectors during transduction. All AAV expression vectors were restriction digested with SmaI or XmaI to ensure the presence of two intact ITRs.

rAAV2 vectors were produced with "Triple Transfection Protocol": (1) pSS vectors with ITRs and transgene cassetts; (2) pHelper plasmid with E2A, E4, VA genes from Adenovirus; (3) pAAV-RC2 plasmid with Rep and Cap genes from AAV2. These three plasmids were mixed at a mass ratio of 3:6:5 and transfected into HEK293 with polymer or lipid-based transfection reagent (e.g. PEI, PEI max, Lipofectamine, TransIT-293, etc.). 60-72 hours post-transfection, HEK293 cells were harvested and sonicated to release viral vectors. Cell lysates underwent CsCl ultracentrifuge to purify and concentrate the viral vectors. Additional purification procedures were performed to obtain higher purity for biophysical assays, including another round of CsCl ultracentrifuge, or sucrose gradient ultracentrifuge, or affinity chromatography. Viral vectors were dialyzed with 1×DPBS twice before being aliquoted for storage in −80° C. Viral preps can be tittered with Dot-Blot protocol or/and quantitative PCR with probes annealing to sequences on the transgenes. PCR primer sequences are: AACATGCTACGCAGAGAGGGAGTGG (SEQ ID NO: 399) (ITR-Titer-fwd) and CATGAGACAAGGAACCCCTAGTGATGGAG (SEQ ID NO: 400) (ITR-Titer-rev). Reference AAV preps were obtained from the Vector Core at University of North Carolina-Chapel Hill as standards. To confirm the presence of three non-structural viral proteins composing the AAV capsid, viral preps were denatured and probed with anti-AAV VP1/VP2/VP3 monoclonal antibody B1 (American Research Products, Inc. Cat #03-65158) on western blots. The results are shown in FIG. 16.

Figure 17:
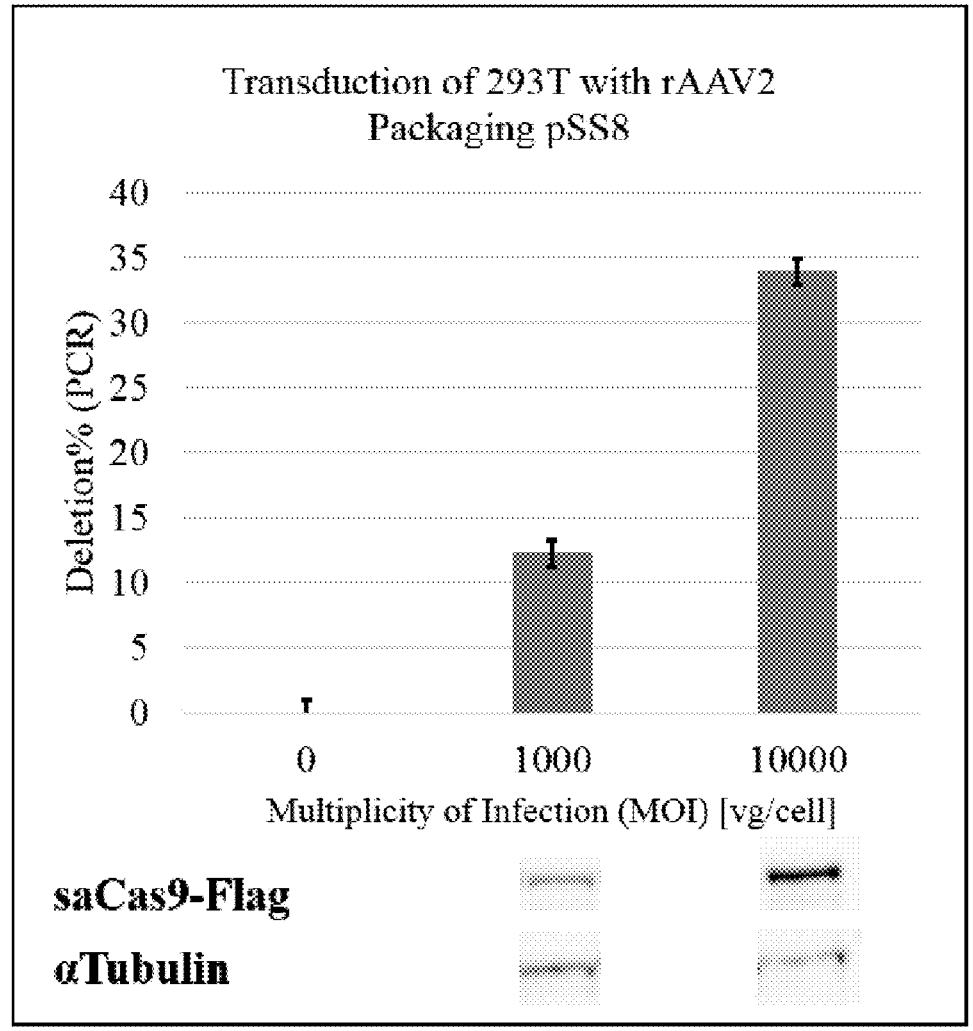
FIG. 17 depicts the deletion rates in 293T cells transduced with AAV viral vectors at MOI of 1000 viral genome (vg) per cell and 10,000 vg per cell. AAV2 viral vectors were produced with "Triple Transfection Protocol" using pHelper, pRep2Cap2, pSS8 encoding gRNAs CEP290-64 and CEP290-323, and CMV-driven saCas9. Viral preps were titered with primers annealing to ITRs on pSS8. 6 days post transduction, gDNA were extracted from 293T cells. Deletion PCR was carried out on the CEP290 locus, and deletion rates were calculated based on the predicted amplicons. Western blotting was carried out to show the AAV-mediated saCas9 expression in 293T cells (primary antibody: anti-Flag, M2; loading control: anti-alphaTubulin).

Example 10: rAAV-Mediated CEP290 Modification In Vitro 293T were transduced with rAAV2 vectors expressing saCas9 with or without gRNA sequences to demonstrate the deletion events near the IVS26 splicing mutant. 293T cells were transduced with rAAV2 viral vectors at an MOI of 1,000 viral genome (vg)/cell or 10,000 vg/cell and harvested at three to seven days post transduction. Western blotting with the primary antibody for Flag (anti-Flag, M2, Sigma-Aldrich) showed that the presence of U6-gRNA-scaffold does not interfere with saCas9 expression. Genomic DNA from 293T was isolated with the Agencourt DNAdvance Kit (Beckman Coulter). Regions including the deletions were PCR amplified from genomic DNA isolated, and analyzed on the QIAxcel capillary electrophoresis machine. Amplicons smaller than the full-length predicted PCR products represent the deletion events in 293T cells. The PCR results are shown in FIG. 17. To further understand the nature of these deletion events, PCR products were cloned into Zero-Blunt TOPO Cloning Kit (Life Technologies) and transformed into chemically competent Top10 cells. Bacterial colonies were then cultured and sequenced using Sanger sequencing. Sequence results were aligned with the wt CEP290 locus for analysis.

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (2780 sequences)

SEQ ID NO: 1 - protein, 1344 aa, Streptococcus mutans
KKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - protein, 1387 aa, Streptococcus thermophilus
TKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 4 - protein, 1333 aa, Listeria innocua
KKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 5 - RNA, 96 nt, Artificial Sequence
  Synthetic oligonucleotide
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugc

SEQ ID NO: 6 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 7 - protein, 1368 aa, Streptococcus pyogenes [sequence omitted]

SEQ ID NO: 8 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (6)..(6): Xaa is Ser or Tyr or Asn or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXXXGXXXX

SEQ ID NO: 9 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXSXGXXXX

SEQ ID NO: 10 - protein, 12 aa, Artificial Sequence
  Synthetic peptide
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (11)..(11): Xaa is Val or Ile or Leu or Ala or Met or His
  VARIANT (12)..(12): Any amino acid or absent
DIGXXSVGWAXX

SEQ ID NO: 11 - protein, 12 aa, Artificial Sequence
  Synthetic peptide
  MOD_RES (12)..(12): Any non-polar alkyl amino acid or a hydroxyl amino acid
DIGTNSVGWAVX

SEQ ID NO: 12 - protein, 8 aa, Artificial Sequence
  Synthetic peptide
  VARIANT (2)..(2): Xaa is Val or His
  VARIANT (3)..(3): Xaa is Ile or Leu or Val
  VARIANT (5)..(5): Xaa is Met or Thr
IXXEXARE

SEQ ID NO: 13 - protein, 8 aa, Artificial Sequence
  Synthetic peptide
  VARIANT (3)..(3): Xaa is Ile or Leu or Val
IVXEMARE

SEQ ID NO: 14 - protein, 8 aa, Artificial Sequence
  Synthetic peptide
  VARIANT (4)..(4): Xaa is His or Leu
  VARIANT (7)..(7): Xaa is Arg or Val
  VARIANT (8)..(8): Xaa is Glu or Val
HHAXDAXX

SEQ ID NO: 15 - protein, 8 aa, Artificial Sequence
  Synthetic peptide
HHAHDAYL

SEQ ID NO: 16 - protein, 30 aa, Artificial Sequence
  Synthetic polypeptide
  VARIANT (2)..(2): Xaa is Lys or Pro
  VARIANT (4)..(4): Xaa is Val or Leu or Ile or Phe
  VARIANT (5)..(5): Xaa is Gly or Ala or Ser
  VARIANT (6)..(6): Xaa is Leu or Ile or Val or Phe
  MOD_RES (7)..(26): Any amino acid and this region may encompass 5-20 residues wherein some positions may be absent
  VARIANT (29)..(29): Xaa is Asp or Glu or Asn or Gln
KXYXXXXXXXXXXXXXXXXXXXXXXXTDXY

SEQ ID NO: 17 - protein, 27 aa, Artificial Sequence
  Synthetic peptide
  VARIANT (1)..(1): Xaa is Asp or Glu or Gln or Asn
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (9)..(9): Xaa is Ser or Ala or Asp or Thr or Lys
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (13)..(13): Xaa is Asp or Ser or Asn or Arg or Leu or Thr
  VARIANT (14)..(14): Xaa is Asp or Asn or Ser
  VARIANT (15)..(15): Xaa is Ser or Ala or Thr or Gly or Arg
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (19)..(19): Xaa is Lys or Leu or Arg or Met or Thr or Phe
  VARIANT (20)..(20): Xaa is Val or Leu or Ile or Ala or Thr
  VARIANT (21)..(21): Xaa is Leu or Ile or Val or Ala
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XXXHXXPXXXXXXXXXXNXXXXXXXXN

SEQ ID NO: 18 - protein, 27 aa, Artificial Sequence
  Synthetic peptide
  VARIANT (1)..(1): Xaa is Asp or Glu
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys Met or Asp or Phe
XXXHXXPXSXXXDDSXXNKVLXXXXXN

SEQ ID NO: 19 - protein, 27 aa, Artificial Sequence
  Synthetic peptide
  VARIANT (1)..(1): Xaa is Asp or Glu
  VARIANT (3)..(3): Xaa is Asp or Glu
  VARIANT (8)..(8): Xaa is Gln or His or Arg or Lys or Tyr or Ile or Leu or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XVXHIVPXSXXXDDSXXNKVLTXXXXN

SEQ ID NO: 20 - protein, 27 aa, Artificial Sequence
  Synthetic peptide
  VARIANT (2)..(2): Xaa is Ile or Val
  VARIANT (6)..(6): Xaa is Ile or Val
  VARIANT (9)..(9): Xaa is Ala or Ser
  VARIANT (11)..(11): Xaa is Ile or Leu
  VARIANT (12)..(12): Xaa is Lys or Thr
  VARIANT (14)..(14): Xaa is Asp or Asn
  VARIANT (19)..(19): Xaa is Arg or Lys or Leu
  VARIANT (22)..(22): Xaa is Thr or Val
  VARIANT (23)..(23): Xaa is Ser or Arg
  VARIANT (25)..(25): Xaa is Lys or Asp or Ala
  VARIANT (26)..(26): Xaa is Glu or Lys or Gly or Asn
DXDHIXPQXFXXDXSIDNXVLXXSXXN

SEQ ID NO: 21 - protein, 73 aa, Artificial Sequence
  Synthetic polypeptide
  VARIANT (8)..(8): Xaa is Lys or Arg
  VARIANT (12)..(12): Xaa is Val or Thr
  VARIANT (13)..(13): Xaa is Gly or Asp
  VARIANT (14)..(14): Xaa is Glu or Gln or Asp
  VARIANT (15)..(15): Xaa is Glu or Asp
  VARIANT (19)..(19): Xaa is Asp or Asn or His
  VARIANT (20)..(20): Xaa is Tyr or Arg or Asn
  VARIANT (23)..(23): Xaa is Gln or Asp or Asn
  MOD_RES (25)..(64): Any amino acid and this region may encompass 15-40 residues wherein some positions may be absent
  VARIANT (67)..(67): Xaa is Gly or Glu
  VARIANT (69)..(69): Xaa is Ser or Gly
  VARIANT (71)..(71): Xaa is Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 22 - DNA, 4107 bp, Artificial Sequence
  Synthetic polynucleotide
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 23 - protein, 1368 aa, Streptococcus pyogenes [sequence omitted]

SEQ ID NO: 24 - DNA, 3249 bp, Artificial Sequence
  Synthetic polynucleotide
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 25 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 26 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 27 - RNA, 104 nt, Artificial Sequence
  Synthetic polynucleotide
  misc_feature (1)..(20): a, c, u, g, unknown or other
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 28 - RNA, 106 nt, Artificial Sequence
  Synthetic polynucleotide
  misc_feature (1)..(20): a, c, u, g, unknown or other
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 29 - RNA, 116 nt, Artificial Sequence
  Synthetic polynucleotide
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 96 nt, Artificial Sequence
  Synthetic oligonucleotide
  misc_feature (1)..(20): a, c, u, g, unknown or other
nnnnnnnnnnnnnnnnnnnnguauuagagcuagaaauagcaaguuaauauaaggcuaguccguuaucaacuugaaaaaguggcaccgagucggugc

SEQ ID NO: 31 - RNA, 96 nt, Artificial Sequence
  Synthetic oligonucleotide
  misc_feature (1)..(20): a, c, u, g, unknown or other
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 116 nt, Artificial Sequence
  Synthetic polynucleotide
  misc_feature (1)..(20): a, c, u, g, unknown or other
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 33 - RNA, 47 nt, Artificial Sequence
  Synthetic oligonucleotide
aaggcuaguccguuaucaacuugaaaaaguggcaccgagucggugcu

SEQ ID NO: 34 - RNA, 49 nt, Artificial Sequence
  Synthetic oligonucleotide
aaggcuaguccguuaucaacuugaaaaaguggcaccgagucgguggugc

SEQ ID NO: 35 - RNA, 51 nt, Artificial Sequence
  Synthetic oligonucleotide
aaggcuaguccguuaucaacuugaaaaaguggcaccgagucggugcggauc

SEQ ID NO: 36 - RNA, 31 nt, Artificial Sequence
  Synthetic oligonucleotide
aaggcuaguccguuaucaacuugaaaaagug

SEQ ID NO: 37 - RNA, 18 nt, Artificial Sequence
  Synthetic oligonucleotide
aaggcuaguccguuauca

SEQ ID NO: 38 - RNA, 12 nt, Artificial Sequence
  Synthetic oligonucleotide
aaggcuaguccg

SEQ ID NO: 39 - DNA, 3159 bp, Artificial Sequence
  Synthetic polynucleotide
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 40-41 - skipped (2 entries)

SEQ ID NO: 42 - RNA, 42 nt, Streptococcus pyogenes
  misc_feature (1)..(20): a, c, u, g, unknown or other
nnnnnnnnnnnnnnnnnnnnguuuuagagcuaugcuguuuug

SEQ ID NO: 43 - RNA, 85 nt, Streptococcus pyogenes
ggaaccauucaaaacagcauagcaaguuaaaauaaggcuaguccguuaucaacuugaaaaaguggcaccgagucggugcuuuuuu

SEQ ID NO: 44 - RNA, 62 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccg

SEQ ID NO: 45 - RNA, 102 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 46 - RNA, 75 nt, Streptococcus pyogenes
  misc_feature (1)..(20): a, c, u, g, unknown or other
nnnnnnnnnnnnnnnnnnnnguuuuagagcuaugcugaaaagcauagcaaguuaaaauaaggcuaguccguuauc

SEQ ID NO: 47 - RNA, 87 nt, Streptococcus pyogenes
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuauc

SEQ ID NO: 48 - RNA, 42 nt, Streptococcus thermophilus
  misc_feature (1)..(20): a, c, u, g, unknown or other
nnnnnnnnnnnnnnnnnnnnguuuuagagcuguguuguuucg

SEQ ID NO: 49 - RNA, 78 nt, Streptococcus thermophilus
gggcgaaacaacacagcgaguuaaaauaaggcuuaguccguacucaacuugaaaagguggcaccgauucgguguuuuu

SEQ ID NO: 50 - RNA, 42 nt, Streptococcus pyogenes; identical to SEQ ID NO: 42
  misc_feature (1)..(20): a, c, u, g, unknown or other

SEQ ID NO: 51 - RNA, 42 nt, Streptococcus thermophilus; identical to SEQ ID NO: 48
  misc_feature (1)..(20): a, c, u, g, unknown or other

SEQ ID NO: 52 - RNA, 85 nt, Streptococcus pyogenes
gaaccauucaaaacagcauagcaaguuaaaauaaggcuaguccguuaucaacuugaaaaaguggcaccgagucggugcuuuuuuu

SEQ ID NO: 53 - RNA, 78 nt, Streptococcus thermophilus; identical to SEQ ID NO: 49

SEQ ID NO: 54 - protein, 12 aa, Artificial Sequence
  Synthetic peptide
DIGTNSVGWAVT

SEQ ID NO: 55 - protein, 12 aa, Artificial Sequence
  Synthetic peptide
DIGTNSVGWAVT

SEQ ID NO: 56 - protein, 12 aa, Artificial Sequence
  Synthetic peptide
DVGTNSVGWAVT

SEQ ID NO: 57 - protein, 12 aa, Artificial Sequence
  Synthetic peptide
DVGTNSVGWAVT

SEQ ID NO: 58 - protein, 12 aa, Artificial Sequence
  Synthetic peptide
DMGTNSVGWAVT

SEQ ID NO: 59 - protein, 12 aa, Artificial Sequence
  Synthetic peptide
DVGTSSVGWAVT

SEQ ID NO: 60 - protein, 12 aa, Artificial Sequence
  Synthetic peptide
DIGTASVGWAVT

SEQ ID NO: 61 - protein, 12 aa, Artificial Sequence
  Synthetic peptide
DVGTGSVGWAVT

SEQ ID NO: 62 - protein, 12 aa, Artificial Sequence
  Synthetic peptide
DIGTNSVGWAVV

SEQ ID NO: 63 - protein, 12 aa, Artificial Sequence
  Synthetic peptide
DIGTNSVGWAVI

SEQ ID NO: 64 - protein, 12 aa, Artificial Sequence
  Synthetic peptide
DIGTNSVGWAVL

SEQ ID NO: 65 - protein, 12 aa, Artificial Sequence
  Synthetic peptide
DLGTNSIGWAVV

SEQ ID NO: 66 - protein, 11 aa, Artificial Sequence
  Synthetic peptide
DLGTNSIGWAI

SEQ ID NO: 67 - protein, 12 aa, Artificial Sequence
  Synthetic peptide
DLGTNSIGWALV

SEQ ID NO: 68 - protein, 12 aa, Artificial Sequence
  Synthetic peptide
DIGTNSVGWCVT

SEQ ID NO: 69 - protein, 12 aa, Artificial Sequence
  Synthetic peptide
DIGTNSVGYAVT

SEQ ID NO: 70 - protein, 12 aa, Artificial Sequence
  Synthetic peptide
DMGTGSLGWAVT

SEQ ID NO: 71 - protein, 12 aa, Artificial Sequence
  Synthetic peptide
DIGTSSVGWAAI

SEQ ID NO: 72 - protein, 12 aa, Artificial Sequence
  Synthetic peptide
DLGTGSVGWAVV

SEQ ID NO: 73 - protein, 12 aa, Artificial Sequence
  Synthetic peptide
DLGVGSVGWAIV

SEQ ID NO: 74 - protein, 12 aa, Artificial Sequence
  Synthetic peptide
DLGIASIGWAII

SEQ ID NO: 75 - protein, 12 aa, Artificial Sequence
  Synthetic peptide
DLGIASVGWAIV

SEQ ID NO: 76 - protein, 12 aa, Artificial Sequence
  Synthetic peptide
DLGVASVGWSIV

SEQ ID NO: 77 - protein, 12 aa, Artificial Sequence
  Synthetic peptide
DIGIASVGWAIL

SEQ ID NO: 78 - protein, 12 aa, Artificial Sequence
  Synthetic peptide
DLGISSVGWSVI

SEQ ID NO: 79 - protein, 12 aa, Artificial Sequence
  Synthetic peptide
DIGIASVGWSVI

SEQ ID NO: 80 - protein, 12 aa, Artificial Sequence
  Synthetic peptide
DVGIGSIGWAVI

SEQ ID NO: 81 - protein, 12 aa, Artificial Sequence
  Synthetic peptide
DLGVGSIGFAIV

SEQ ID NO: 82 - protein, 12 aa, Artificial Sequence
  Synthetic peptide
DIGYASIGWAVI

SEQ ID NO: 83 - protein, 12 aa, Artificial Sequence
  Synthetic peptide
DTGTNSLGWAIV

SEQ ID NO: 84 - protein, 12 aa, Artificial Sequence
  Synthetic peptide
DLGTNSIGWCLL

SEQ ID NO: 85 - protein, 12 aa, Artificial Sequence
  Synthetic peptide
DIGTDSLGWAVF

SEQ ID NO: 86 - protein, 12 aa, Artificial Sequence
  Synthetic peptide
DIGSNSIGFAVV

SEQ ID NO: 87 - protein, 12 aa, Artificial Sequence
  Synthetic peptide
DLGVGSIGVAVA

SEQ ID NO: 88 - protein, 12 aa, Artificial Sequence
  Synthetic peptide
DLGIASCGWGVV

SEQ ID NO: 89 - protein, 12 aa, Artificial Sequence
  Synthetic peptide
DLGIASVGWCLT

SEQ ID NO: 90 - protein, 12 aa, Artificial Sequence
  Synthetic peptide
DIGIGSVGVGIL

SEQ ID NO: 91 - protein, 12 aa, Artificial Sequence
  Synthetic peptide
DIGITSVGYGLI

SEQ ID NO: 92 - protein, 12 aa, Artificial Sequence
  Synthetic peptide
DIGITSVGFGII

SEQ ID NO: 93 - protein, 12 aa, Artificial Sequence
  Synthetic peptide
DVGITSTGYAVL

SEQ ID NO: 94 - protein, 12 aa, Artificial Sequence
  Synthetic peptide
DLGITSFGYAIL

SEQ ID NO: 95 - protein, 12 aa, Artificial Sequence
  Synthetic peptide
DIGNASVGWSAF

SEQ ID NO: 96 - protein, 12 aa, Artificial Sequence
  Synthetic peptide
DVGTNSCGWVAM

SEQ ID NO: 97 - protein, 12 aa, Artificial Sequence
  Synthetic peptide
DVGERSIGLAAV

SEQ ID NO: 98 - protein, 12 aa, Artificial Sequence
  Synthetic peptide
DVGLNSVGLAAV

SEQ ID NO: 99 - protein, 12 aa, Artificial Sequence
  Synthetic peptide
DVGLMSVGLAAI

SEQ ID NO: 100 - protein, 12 aa, Artificial Sequence
  Synthetic peptide
DVGTFSVGLAAI

SEQ ID NO: 101 - protein, 12 aa, Artificial Sequence
  Synthetic peptide
DIGTGSVGYACM

SEQ ID NO: 102 - protein, 12 aa, Artificial Sequence
  Synthetic peptide
DLGTTSIGFAHI

SEQ ID NO: 103 - protein, 12 aa, Artificial Sequence
  Synthetic peptide
DLGTNSIGSSVR

SEQ ID NO: 104 - protein, 12 aa, Artificial Sequence
  Synthetic peptide
DIGTNSVGWAVT

SEQ ID NO: 105 - protein, 12 aa, Artificial Sequence
  Synthetic peptide
DIGTNSVGWAVT

SEQ ID NO: 106 - protein, 12 aa, Artificial Sequence
  Synthetic peptide
DVGTNSVGWAVT

SEQ ID NO: 107 - protein, 12 aa, Artificial Sequence
  Synthetic peptide
DVGTNSVGWAVT

SEQ ID NO: 108 - protein, 12 aa, Artificial Sequence
  Synthetic peptide
DMGTNSVGWAVT

SEQ ID NO: 109 - protein, 12 aa, Artificial Sequence
  Synthetic peptide
DVGTSSVGWAVT

SEQ ID NO: 110 - protein, 12 aa, Artificial Sequence
  Synthetic peptide
DIGTASVGWAVT

SEQ ID NO: 111 - protein, 12 aa, Artificial Sequence
  Synthetic peptide
DVGTGSVGWAVT

SEQ ID NO: 112 - protein, 12 aa, Artificial Sequence
  Synthetic peptide
DIGTNSVGWAVV

SEQ ID NO: 113 - protein, 12 aa, Artificial Sequence
  Synthetic peptide
DIGTNSVGWAVI

SEQ ID NO: 114 - protein, 12 aa, Artificial Sequence
  Synthetic peptide
DIGTNSIGWAVI

SEQ ID NO: 115 - protein, 12 aa, Artificial Sequence
  Synthetic peptide
DIGTNSVGWAVL

SEQ ID NO: 116 - protein, 12 aa, Artificial Sequence
  Synthetic peptide
DLGTNSIGWAVV

SEQ ID NO: 117 - protein, 11 aa, Artificial Sequence
  Synthetic peptide
DLGTNSIGWAI

SEQ ID NO: 118 - protein, 12 aa, Artificial Sequence
  Synthetic peptide
DLGTNSIGWALV

SEQ ID NO: 119 - protein, 12 aa, Artificial Sequence
  Synthetic peptide
DIGTNSVGWCVT

SEQ ID NO: 120 - protein, 12 aa, Artificial Sequence
  Synthetic peptide
DIGTNSVGYAVT

SEQ ID NO: 121 - protein, 12 aa, Artificial Sequence
  Synthetic peptide
DMGTGSLGWAVT

SEQ ID NO: 122 - protein, 12 aa, Artificial Sequence
  Synthetic peptide
DIGTSSVGWAAI

SEQ ID NO: 123 - protein, 12 aa, Artificial Sequence
  Synthetic peptide
DLGTGSVGWAVV

SEQ ID NO: 124 - protein, 12 aa, Artificial Sequence
  Synthetic peptide
DLGVGSVGWAIV

SEQ ID NO: 125 - protein, 12 aa, Artificial Sequence
  Synthetic peptide
DLGIASIGWAII

SEQ ID NO: 126 - protein, 12 aa, Artificial Sequence
  Synthetic peptide
DLGIASVGWAIV

SEQ ID NO: 127 - protein, 12 aa, Artificial Sequence
  Synthetic peptide
DLGIASVGWAVV

SEQ ID NO: 128 - protein, 12 aa, Artificial Sequence
  Synthetic peptide
DLGVASVGWSIV

SEQ ID NO: 129 - protein, 12 aa, Artificial Sequence
  Synthetic peptide
DIGIASVGWAIL

SEQ ID NO: 130 - protein, 12 aa, Artificial Sequence
  Synthetic peptide
DIGIASVGWAVL

SEQ ID NO: 131 - protein, 12 aa, Artificial Sequence
  Synthetic peptide
DIGIASIGWAVI

SEQ ID NO: 132 - protein, 12 aa, Artificial Sequence
  Synthetic peptide
DIGIASVGWAII

SEQ ID NO: 133 - protein, 12 aa, Artificial Sequence
  Synthetic peptide
DVGIASVGWAVI

SEQ ID NO: 134 - protein, 11 aa, Artificial Sequence
  Synthetic peptide
DIGIASVGWAL

SEQ ID NO: 135 - protein, 12 aa, Artificial Sequence
  Synthetic peptide
DIGIASVGWAMV

SEQ ID NO: 136 - protein, 12 aa, Artificial Sequence
  Synthetic peptide
DIGIASVGWSVI

SEQ ID NO: 137 - protein, 12 aa, Artificial Sequence
  Synthetic peptide
DLGISSVGWSVI

SEQ ID NO: 138 - protein, 12 aa, Artificial Sequence
  Synthetic peptide
DIGITSVGWAVI

SEQ ID NO: 139 - protein, 12 aa, Artificial Sequence
  Synthetic peptide
DVGIGSIGWAVI

SEQ ID NO: 140 - protein, 12 aa, Artificial Sequence
  Synthetic peptide
DLGISSLGWAIV

SEQ ID NO: 141 - protein, 12 aa, Artificial Sequence
  Synthetic peptide
DLGVGSIGFAIV

SEQ ID NO: 142 - protein, 12 aa, Artificial Sequence
  Synthetic peptide
DIGYASIGWAVI

SEQ ID NO: 143 - protein, 12 aa, Artificial Sequence
  Synthetic peptide
DLGTNSIGWCLL

SEQ ID NO: 144 - protein, 12 aa, Artificial Sequence
  Synthetic peptide
DLGTNSIGWGLL

SEQ ID NO: 145 - protein, 12 aa, Artificial Sequence
  Synthetic peptide
DTGTNSLGWAIV

SEQ ID NO: 146 - protein, 12 aa, Artificial Sequence
  Synthetic peptide
DIGTDSLGWAVF

SEQ ID NO: 147 - protein, 12 aa, Artificial Sequence
  Synthetic peptide
DLGSTSLGWAIF

SEQ ID NO: 148 - protein, 12 aa, Artificial Sequence
  Synthetic peptide
DIGISSIGWAFS

SEQ ID NO: 149 - protein, 12 aa, Artificial Sequence
  Synthetic peptide
DLGIASVGWCLT

SEQ ID NO: 150 - protein, 12 aa, Artificial Sequence
  Synthetic peptide
DLGIASCGWGVV

SEQ ID NO: 151 - protein, 12 aa, Artificial Sequence
  Synthetic peptide
DIGSNSIGFAVV

SEQ ID NO: 152 - protein, 12 aa, Artificial Sequence
  Synthetic peptide
DIGTTSIGFSVI

SEQ ID NO: 153 - protein, 12 aa, Artificial Sequence
  Synthetic peptide
DIGITSVGYGLI

SEQ ID NO: 154 - protein, 12 aa, Artificial Sequence
  Synthetic peptide
DIGITSVGFGII

SEQ ID NO: 155 - protein, 12 aa, Artificial Sequence
  Synthetic peptide
DLGTTSIGFAHI

SEQ ID NO: 156 - protein, 12 aa, Artificial Sequence
  Synthetic peptide
DIGIGSVGVGIL

SEQ ID NO: 157 - protein, 12 aa, Artificial Sequence
  Synthetic peptide
DLGVGSIGVAVA

SEQ ID NO: 158 - protein, 12 aa, Artificial Sequence
  Synthetic peptide
DVGITSTGYAVL

SEQ ID NO: 159 - protein, 12 aa, Artificial Sequence
  Synthetic peptide
DLGITSFGYAIL

SEQ ID NO: 160 - protein, 12 aa, Artificial Sequence
  Synthetic peptide
DIGTSSIGWWLY

SEQ ID NO: 161 - protein, 12 aa, Artificial Sequence
  Synthetic peptide
DLGSNSLGWFVT

SEQ ID NO: 162 - protein, 12 aa, Artificial Sequence
  Synthetic peptide
DLGANSLGWFVV

SEQ ID NO: 163 - protein, 12 aa, Artificial Sequence
  Synthetic peptide
DIGNASVGWSAF

SEQ ID NO: 164 - protein, 12 aa, Artificial Sequence
  Synthetic peptide
DVGTNSCGWVAM

SEQ ID NO: 165 - protein, 12 aa, Artificial Sequence
  Synthetic peptide
DVGERSIGLAAV

SEQ ID NO: 166 - protein, 12 aa, Artificial Sequence
  Synthetic peptide
DVGLNSVGLAAV

SEQ ID NO: 167 - protein, 12 aa, Artificial Sequence
  Synthetic peptide
DVGLMSVGLAAI

SEQ ID NO: 168 - protein, 12 aa, Artificial Sequence
  Synthetic peptide
DVGTFSVGLAAI

SEQ ID NO: 169 - protein, 12 aa, Artificial Sequence
  Synthetic peptide
DIGTGSVGYACM

SEQ ID NO: 170 - protein, 12 aa, Artificial Sequence
  Synthetic peptide
DLGTNSIGSSVR

SEQ ID NO: 171 - protein, 15 aa, Artificial Sequence
  Synthetic peptide
DIGLRIGITSCGWSI

SEQ ID NO: 172 - protein, 12 aa, Artificial Sequence
  Synthetic peptide
DMGAKYTGVFYA

SEQ ID NO: 173 - protein, 12 aa, Artificial Sequence
  Synthetic peptide
DLGGKNTGFFSF

SEQ ID NO: 174 - protein, 12 aa, Artificial Sequence
  Synthetic peptide
DLGVKNTGVFSA

SEQ ID NO: 175 - protein, 12 aa, Artificial Sequence
  Synthetic peptide
DLGAKFTGVALY

SEQ ID NO: 176 - protein, 12 aa, Artificial Sequence
  Synthetic peptide
DLGGKFTGVCLS

SEQ ID NO: 177 - protein, 12 aa, Artificial Sequence
  Synthetic peptide
DLGGTYTGTFIT

SEQ ID NO: 178 - protein, 28 aa, Artificial Sequence
  Synthetic peptide
YDIDHIYPRSLTKDDSFDNLVLCERTAN

SEQ ID NO: 179 - protein, 28 aa, Artificial Sequence
  Synthetic peptide
DIDHIYPRSKVIKDDSFDNLVLVLKNEN

SEQ ID NO: 180 - protein, 27 aa, Artificial Sequence
  Synthetic peptide
DRDHIYPQSKIKDDSIDNLVLVNKTYN

SEQ ID NO: 181 - protein, 27 aa, Artificial Sequence
  Synthetic peptide
DIDHIYPRSKIKDDSITNRVLVEKDIN

SEQ ID NO: 182 - protein, 27 aa, Artificial Sequence
  Synthetic peptide
DIDHIYPQSKIKDDSISNRVLVCSSCN

SEQ ID NO: 183 - protein, 27 aa, Artificial Sequence
  Synthetic peptide
DIDHIYPQSKTMDDSLNNRVLVKKNYN

SEQ ID NO: 184 - protein, 27 aa, Artificial Sequence
  Synthetic peptide
DQDHIYPKSKIYDDSLENRVLVKKNLN

SEQ ID NO: 185 - protein, 27 aa, Artificial Sequence
  Synthetic peptide
QIDHIVPQSLVKDDSFDNRVLVVPSEN

SEQ ID NO: 186 - protein, 27 aa, Artificial Sequence
  Synthetic peptide
DIDHIIPQAFIKDNSIDNRVLTSSKEN

SEQ ID NO: 187 - protein, 27 aa, Artificial Sequence
  Synthetic peptide
DIDHIIPQAFLKDNSIDNKVLVSSASN

SEQ ID NO: 188 - protein, 27 aa, Artificial Sequence
  Synthetic peptide
DIDHIIPQAYTKDNSLDNRVLVSNITN

SEQ ID NO: 189 - protein, 27 aa, Artificial Sequence
  Synthetic peptide
DIDHIVPQSFITDNSIDNLVLTSSAGN

SEQ ID NO: 190 - protein, 27 aa, Artificial Sequence
  Synthetic peptide
DVDHIVPQSFLKDDSIDNKVLTRSDKN

SEQ ID NO: 191 - protein, 27 aa, Artificial Sequence
  Synthetic peptide
NIDHIYPQSMVKDDSLDNKVLVQSEIN

SEQ ID NO: 192 - protein, 27 aa, Artificial Sequence
  Synthetic peptide
DIDHILPQSLIKDDSLDNRVLVNATIN

SEQ ID NO: 193 - protein, 27 aa, Artificial Sequence
  Synthetic peptide
DIDHILPQSFIKDDSLENRVLVKKAVN

SEQ ID NO: 194 - protein, 27 aa, Artificial Sequence
  Synthetic peptide
EVDHIFPRSFIKDDSIDNKVLVIKKMN

SEQ ID NO: 195 - protein, 27 aa, Artificial Sequence
  Synthetic peptide
EVDHIIPRSYIKDDSFENKVLVYREEN

SEQ ID NO: 196 - protein, 27 aa, Artificial Sequence
  Synthetic peptide
DIDHIIPQAVTQNDSIDNRVLVARAEN

SEQ ID NO: 197 - protein, 27 aa, Artificial Sequence
  Synthetic peptide
EIDHIIPYSISFDDSSSNKLLVLAESN

SEQ ID NO: 198 - protein, 27 aa, Artificial Sequence
  Synthetic peptide
EIDHIIPYSLCFDDSSANKVLVHKQSN

SEQ ID NO: 199 - protein, 27 aa, Artificial Sequence
  Synthetic peptide
DIDHIIPYSRSMDDSYSNKVLVLSGEN

SEQ ID NO: 200 - protein, 27 aa, Artificial Sequence
  Synthetic peptide
DIDHIIPYSKSMDDSFNNKVLCLAEEN

SEQ ID NO: 201 - protein, 27 aa, Artificial Sequence
  Synthetic peptide
EIDHIYPYSRSFDDSYMNKVLVFTKQN

SEQ ID NO: 202 - protein, 27 aa, Artificial Sequence
  Synthetic peptide
QIDHIYPYSRSMDDSYMNKVLVLTDEN

SEQ ID NO: 203 - protein, 27 aa, Artificial Sequence
  Synthetic peptide
EIDHIIPFSRSFDDSLSNKILVLGSEN

SEQ ID NO: 204 - protein, 27 aa, Artificial Sequence
  Synthetic peptide
EIDHALPFSRTWDDSFNNKVLVLGSEN

SEQ ID NO: 205 - protein, 27 aa, Artificial Sequence
  Synthetic peptide
EIDHALPFSRTWDDSFNNKVLVLASEN

SEQ ID NO: 206 - protein, 27 aa, Artificial Sequence
  Synthetic peptide
EIDHIIPISISLDDSINNKVLVLSKAN

SEQ ID NO: 207 - protein, 27 aa, Artificial Sequence
  Synthetic peptide
EVDHIIPISISLDDSITNKVLVTHREN

SEQ ID NO: 208 - protein, 27 aa, Artificial Sequence
  Synthetic peptide
QVDHALPYSRSYDDSKNNKVLVLTHEN

SEQ ID NO: 209 - protein, 27 aa, Artificial Sequence
  Synthetic peptide
EVDHILPLSITFDDSLANKVLVYATAN

SEQ ID NO: 210 - protein, 27 aa, Artificial Sequence
  Synthetic peptide
EIDHIIPRSISFDDARSNKVLVYRSEN

SEQ ID NO: 211 - protein, 27 aa, Artificial Sequence
  Synthetic peptide
EVDHIIPRSVSFDNSYHNKVLVKQSEN

SEQ ID NO: 212 - protein, 27 aa, Artificial Sequence
  Synthetic peptide
DIDHILPYSITFDDSFRNKVLVTSQEN

SEQ ID NO: 213 - protein, 27 aa, Artificial Sequence
  Synthetic peptide
EIDHILPRSRSADDSFANKVLCLARAN

SEQ ID NO: 214 - protein, 27 aa, Artificial Sequence
  Synthetic peptide
EIEHLLPFSLTLDDSMANKTVCFRQAN

SEQ ID NO: 215 - protein, 27 aa, Artificial Sequence
  Synthetic peptide
DIDHILPFSVSLDDSAANKVVCLREAN

SEQ ID NO: 216 - protein, 27 aa, Artificial Sequence
  Synthetic peptide
DIDHLIPFSISWDDSAANKVVCMRYAN

SEQ ID NO: 217 - protein, 27 aa, Artificial Sequence
  Synthetic peptide
DIDHILPVAMTLDDSPANKIICMRYAN

SEQ ID NO: 218 - protein, 27 aa, Artificial Sequence
  Synthetic peptide
DVDHILPYSRTLDDSFPNRTLCLREAN

SEQ ID NO: 219 - protein, 27 aa, Artificial Sequence
  Synthetic peptide
EIEHILPFSRTLDDSLNNRTVAMRRAN

SEQ ID NO: 220 - protein, 27 aa, Artificial Sequence
  Synthetic peptide
EVDHIIPYSISWDDSYTNKVLTSAKCN

SEQ ID NO: 221 - protein, 27 aa, Artificial Sequence
  Synthetic peptide
QVDHILPWSRFGDDSYLNKTLCTARSN

SEQ ID NO: 222 - protein, 27 aa, Artificial Sequence
  Synthetic peptide
QVDHILPFSKTLDDSFANKVLAQHDAN

SEQ ID NO: 223 - protein, 27 aa, Artificial Sequence
  Synthetic peptide
QIDHAFPLSRSLDDSQSNKVLCLTSSN

SEQ ID NO: 224 - protein, 27 aa, Artificial Sequence
  Synthetic peptide
DIDHIVPRSISFDDSFSNLVIVNKLDN

SEQ ID NO: 225 - protein, 27 aa, Artificial Sequence
  Synthetic peptide
EIEHIIPYSMSYDNSQANKILTEKAEN

SEQ ID NO: 226 - protein, 27 aa, Artificial Sequence
  Synthetic peptide
EIDHVIPYSKSADDSWFNKLLVKKSTN

SEQ ID NO: 227 - protein, 27 aa, Artificial Sequence
  Synthetic peptide
EMDHILPYSRSLDNGWHNRVLVHGKDN

SEQ ID NO: 228 - protein, 27 aa, Artificial Sequence
  Synthetic peptide
EVDHIVPYSLILDNTINNKALVYAEEN

SEQ ID NO: 229 - protein, 27 aa, Artificial Sequence
  Synthetic peptide
EIEHVIPQSLYFDDSFSNKVICEAEVN

SEQ ID NO: 230 - protein, 27 aa, Artificial Sequence
  Synthetic peptide
DIEHIIPQARLFDDSFSNKTLEARSVN

SEQ ID NO: 231 - protein, 27 aa, Artificial Sequence
  Synthetic peptide
EIEHIVPKARVFDDSFSNKTLTFHRIN

SEQ ID NO: 232 - protein, 28 aa, Artificial Sequence
  Synthetic peptide
DKDHIIPQSMKKDDSIINNLVLVNKNAN

SEQ ID NO: 233 - protein, 27 aa, Artificial Sequence
  Synthetic peptide
EVEHIWPRSRSFDNSPRNKTLCRKDVN

SEQ ID NO: 234 - protein, 27 aa, Artificial Sequence
  Synthetic peptide
IVNHIIPYNRSFDDTYHNRVLTLTETK

SEQ ID NO: 235 - protein, 27 aa, Artificial Sequence
  Synthetic peptide
DMEHTIPKSISFDNSDQNLTLCESYYN

SEQ ID NO: 236 - protein, 27 aa, Artificial Sequence
  Synthetic peptide
DIEHTIPRSAGGDSTKMNLTLCSSRFN

SEQ ID NO: 237 - protein, 27 aa, Artificial Sequence
  Synthetic peptide
DIEHTIPRSISQDNSQMNKTLCSLKFN

SEQ ID NO: 238 - protein, 27 aa, Artificial Sequence
  Synthetic peptide
DIDHVIPLARGGRDSLDNMVLCQSDAN

SEQ ID NO: 239 - protein, 27 aa, Artificial Sequence
  Synthetic peptide
DIEHLFPIAESEDNGRNNLVISHSACN

SEQ ID NO: 240 - protein, 27 aa, Artificial Sequence
  Synthetic peptide
DVDHIFPRDDTADNSYGNKVVAHRQCN

SEQ ID NO: 241 - protein, 27 aa, Artificial Sequence
  Synthetic peptide
DIEHIVPQSLGGLSTDYNTIVTLKSVN

SEQ ID NO: 242 - protein, 27 aa, Artificial Sequence
  Synthetic peptide
ELDHIVPRTDGGSNRHENLAITCGACN

SEQ ID NO: 243 - protein, 28 aa, Artificial Sequence
  Synthetic peptide
EMDHIVPRKGVGSTNTRTNFAAVCAECN

SEQ ID NO: 244 - protein, 28 aa, Artificial Sequence
  Synthetic peptide
EMDHIVPRKGVGSTNTRVNLAAACAACN

SEQ ID NO: 245 - protein, 28 aa, Artificial Sequence
  Synthetic peptide
EMDHIVPRAGQGSTNTRENLVAVCHRCN

SEQ ID NO: 246 - protein, 33 aa, Artificial Sequence
  Synthetic polypeptide
EIDHILPRSLIKDARGIVFNAEPNLIYASSRGN

SEQ ID NO: 247 - protein, 33 aa, Artificial Sequence
  Synthetic polypeptide
EIDHIIPRSLTGRTKKTVFNSEANLIYCSSKGN

SEQ ID NO: 248 - protein, 33 aa, Artificial Sequence
  Synthetic polypeptide
EIDHIIPRSLTLKKSESIYNSEVNLIFVSAQGN

SEQ ID NO: 249 - protein, 33 aa, Artificial Sequence
  Synthetic polypeptide
EIDHIYPRSLSKKHFGVIFNSEVNLIYCSSQGN

SEQ ID NO: 250 - protein, 33 aa, Artificial Sequence
  Synthetic polypeptide
EIDHILPRSHTLKIYGTVFNPEGNLIYVHQKCN

SEQ ID NO: 251 - protein, 30 aa, Artificial Sequence
  Synthetic polypeptide
ELDHIIPRSHKKYGTLNDEANLICVTRGDN

SEQ ID NO: 252 - protein, 27 aa, Artificial Sequence
  Synthetic peptide
ELEHIVPHSFRQSNALSSLVLTWPGVN

SEQ ID NO: 253 - protein, 28 aa, Artificial Sequence
  Synthetic peptide
YDIDHIYPRSLTKDDSFDNLVLCERTAN

SEQ ID NO: 254 - protein, 28 aa, Artificial Sequence
  Synthetic peptide
DIDHIYPRSKVIKDDSFDNLVLVLKNEN

SEQ ID NO: 255 - protein, 27 aa, Artificial Sequence
  Synthetic peptide
DRDHIYPQSKIKDDSIDNLVLVNKTYN

SEQ ID NO: 256 - protein, 27 aa, Artificial Sequence
  Synthetic peptide
DIDHIYPRSKIKDDSITNRVLVEKDIN

SEQ ID NO: 257 - protein, 27 aa, Artificial Sequence
  Synthetic peptide
DIDHIYPQSKIKDDSISNRVLVCSSCN

SEQ ID NO: 258 - protein, 27 aa, Artificial Sequence
  Synthetic peptide
DIDHIYPQSKTMDDSLNNRVLVKKNYN

SEQ ID NO: 259 - protein, 27 aa, Artificial Sequence
  Synthetic peptide
DQDHIYPKSKIYDDSLENRVLVKKNLN

SEQ ID NO: 260 - protein, 27 aa, Artificial Sequence
  Synthetic peptide
QIDHIVPQSLVKDDSFDNRVLVVPSEN

SEQ ID NO: 261 - protein, 27 aa, Artificial Sequence
  Synthetic peptide
DIDHIIPQAFIKDNSIDNRVLTSSKEN

SEQ ID NO: 262 - protein, 27 aa, Artificial Sequence
  Synthetic peptide
DIDHIIPQAFLKDNSIDNKVLVSSASN

SEQ ID NO: 263 - protein, 27 aa, Artificial Sequence
  Synthetic peptide
DIDHIIPQAYTKDNSLDNRVLVSNITN

SEQ ID NO: 264 - protein, 27 aa, Artificial Sequence
  Synthetic peptide
DIDHIVPQSFITDNSIDNLVLTSSAGN

SEQ ID NO: 265 - protein, 27 aa, Artificial Sequence
  Synthetic peptide
DVDHIVPQSFLKDDSIDNKVLTRSDKN

SEQ ID NO: 266 - protein, 27 aa, Artificial Sequence
  Synthetic peptide
NIDHIYPQSMVKDDSLDNKVLVQSEIN

SEQ ID NO: 267 - protein, 27 aa, Artificial Sequence
  Synthetic peptide
DIDHILPQSLIKDDSLDNRVLVNATIN

SEQ ID NO: 268 - protein, 27 aa, Artificial Sequence
  Synthetic peptide
DIDHILPQSFIKDDSLENRVLVKKAVN

SEQ ID NO: 269 - protein, 27 aa, Artificial Sequence
  Synthetic peptide
EVDHIFPRSFIKDDSIDNKVLVIKKMN

SEQ ID NO: 270 - protein, 27 aa, Artificial Sequence
  Synthetic peptide
EVDHIIPRSYIKDDSFENKVLVYREEN

SEQ ID NO: 271 - protein, 27 aa, Artificial Sequence
  Synthetic peptide
DIDHIIPQAVTQNDSIDNRVLVARAEN

SEQ ID NO: 272 - protein, 27 aa, Artificial Sequence
  Synthetic peptide
DIDHIVPRSISFDDSFSNLVIVNKLDN

SEQ ID NO: 273 - protein, 27 aa, Artificial Sequence
  Synthetic peptide
EIDHIIPYSISFDDSSSNKLLVLAESN

SEQ ID NO: 274 - protein, 27 aa, Artificial Sequence
  Synthetic peptide
EIDHIIPYSLCFDDSSANKVLVHKQSN

SEQ ID NO: 275 - protein, 27 aa, Artificial Sequence
  Synthetic peptide
EIDHIIPISISLDDSINNKVLVLSKAN

SEQ ID NO: 276 - protein, 27 aa, Artificial Sequence
  Synthetic peptide
EVDHIIPISISLDDSITNKVLVTHREN

SEQ ID NO: 277 - protein, 27 aa, Artificial Sequence
  Synthetic peptide
EVDHILPLSITFDDSLANKVLVYATAN

SEQ ID NO: 278 - protein, 27 aa, Artificial Sequence
  Synthetic peptide
EIDHIIPRSISFDDARSNKVLVYRSEN

SEQ ID NO: 279 - protein, 27 aa, Artificial Sequence
  Synthetic peptide
EVDHIIPRSVSFDNSYHNKVLVKQSEN

SEQ ID NO: 280 - protein, 27 aa, Artificial Sequence
  Synthetic peptide
EVDHIIPYSISWDDSYTNKVLTSAKCN

SEQ ID NO: 281 - protein, 27 aa, Artificial Sequence
  Synthetic peptide
DIDHIIPYSRSMDDSYSNKVLVLSGEN

SEQ ID NO: 282 - protein, 27 aa, Artificial Sequence
  Synthetic peptide
EIEHIIPYSMSYDNSQANKILTEKAEN

SEQ ID NO: 283 - protein, 27 aa, Artificial Sequence
  Synthetic peptide
EVDHIVPYSLILDNTINNKALVYAEEN

SEQ ID NO: 284 - protein, 27 aa, Artificial Sequence
  Synthetic peptide
EIDHVIPYSKSADDSWFNKLLVKKSTN

SEQ ID NO: 285 - protein, 27 aa, Artificial Sequence
  Synthetic peptide
EMDHILPYSRSLDNGWHNRVLVHGKDN

SEQ ID NO: 286 - protein, 27 aa, Artificial Sequence
  Synthetic peptide
EIEHVIPQSLYFDDSFSNKVICEAEVN

SEQ ID NO: 287 - protein, 27 aa, Artificial Sequence
  Synthetic peptide
DIEHIIPQARLFDDSFSNKTLEARSVN

SEQ ID NO: 288 - protein, 27 aa, Artificial Sequence
  Synthetic peptide
EIEHIVPKARVFDDSFSNKTLTFHRIN

SEQ ID NO: 289 - protein, 28 aa, Artificial Sequence
  Synthetic peptide
DKDHIIPQSMKKDDSIINNLVLVNKNAN

SEQ ID NO: 290 - protein, 27 aa, Artificial Sequence
  Synthetic peptide
QVDHILPWSRFGDDSYLNKTLCTARSN

SEQ ID NO: 291 - protein, 27 aa, Artificial Sequence
  Synthetic peptide
DIDHVIPLARGGRDSLDNMVLCQSDAN

SEQ ID NO: 292 - protein, 27 aa, Artificial Sequence
  Synthetic peptide
DMEHTIPKSISFDNSDQNLTLCESYYN

SEQ ID NO: 293 - protein, 27 aa, Artificial Sequence
  Synthetic peptide
DIEHTIPRSAGGDSTKMNLTLCSSRFN

SEQ ID NO: 294 - protein, 27 aa, Artificial Sequence
  Synthetic peptide
DIEHTIPRSISQDNSQMNKTLCSLKFN

SEQ ID NO: 295 - protein, 27 aa, Artificial Sequence
  Synthetic peptide
DIEHLFPIAESEDNGRNNLVISHSACN

SEQ ID NO: 296 - protein, 27 aa, Artificial Sequence
  Synthetic peptide
DVDHIFPRDDTADNSYGNKVVAHRQCN

SEQ ID NO: 297 - protein, 27 aa, Artificial Sequence
  Synthetic peptide
DIEHIVPQSLGGLSTDYNTIVTLKSVN

SEQ ID NO: 298 - protein, 27 aa, Artificial Sequence
  Synthetic peptide
ELDHIVPRTDGGSNRHENLAITCGACN

SEQ ID NO: 299 - protein, 28 aa, Artificial Sequence
  Synthetic peptide
EMDHIVPRKGVGSTNTRTNFAAVCAECN

SEQ ID NO: 300 - protein, 28 aa, Artificial Sequence
  Synthetic peptide
EMDHIVPRKGVGSTNTRVNLAAACAACN

SEQ ID NO: 301 - protein, 28 aa, Artificial Sequence
  Synthetic peptide
EMDHIVPRAGQGSTNTRENLVAVCHRCN

SEQ ID NO: 302 - protein, 27 aa, Artificial Sequence
  Synthetic peptide
ELEHIVPHSFRQSNALSSLVLTWPGVN

SEQ ID NO: 303 - DNA, 3333 bp, Artificial Sequence
  Synthetic polynucleotide
atggtgcctaagaagaagagaaaggtggctgccttcaaacctaattcaatcaactacatcctcggcctcgatatcggcatcgcatccgtcggctgggcgatggtagaaattgacgaagaagaaaaccccatccgcctgattgatttgggcgtgcgcgtatttgagcgtgccgaagtaccgaaaacaggcgactcccttgccatggcaaggcgtttggcgcgcagtgttcgccgcctgacccgccgtcgcgcccaccgcctgcttcggacccgccgcctattgaaacgcgaaggcgtattacaagccgccaattttgacgaaaacggcttgattaaatccttaccgaatacaccatggcaacttcgcgcagccgcattagaccgcaaactgacgcctttagagtggtcggcagtcttgttgcatttaatcaaacatcgcggctatttatcgcaacggaaaaacgagggcgaaactgccgataaggagcttggcgctttgcttaaaggcgtagccggcaatgcccatgccttacagacaggcgatttccgcacaccggccgaattggctttaaataaatttgagaaagaaagcggccatatccgcaatcagcgcagcgattattcgcatacgttcagccgcaaagatttacaggcggagctgattttgctgtttgaaaaacaaaaagaatttggcaatccgcatgtttcaggcggccttaaagaaggtattgaaaccctactgatgacgcaacgccctgccctgtccggcgatgccgttcaaaaaatgttggggcattgcaccttcgaaccggcagagccgaaagccgctaaaaacacctacacagccgaacgtttcatctggctgaccaagctgaacaacctgcgtattttagagcaaggcagcgagcggccattgaccgataccgaacgcgccacgcttatggacgagccatacagaaaatccaaactgacttacgcacaagcccgtaagctgctgggtttagaagataccgcctttttcaaaggcttgcgctatggtaaagacaatgccgaagcctcaacattgatggaaatgaaggcctaccatgccatcagccgtgcactggaaaaagaaggattgaaagacaaaaaatccccattaaacctttctcccgaattacaagacgaaatcggcacggcattctccctgttcaaaaccgatgaagacattacaggccgtctgaaagaccgtatacagcccgaaatcttagaagcgctgttgaaacacatcagcttcgataagttcgtccaaatttccttgaaagcattgcgccgaattgtgcctctaatggaacaaggcaaacgttacgatgaagcctgcgccgaaatctacggagaccattacggcaagaagaatacggaagaaaagatttatctgccgccgattcccgccgacgaaatccgcaaccccgtcgtcttgcgcgccttatctcaagcacgtaaggtcattaacggcgtggtacgccgttacggctccccagctcgtatccatattgaaactgcaagggaagtaggtaaatcgtttaaagaccgcaaagaaattgagaaacgccaagaagaaaaccgcaaagaccgggaaaaagccgccgccaaattccgagagtatttccccaattttgtcggagaacccaaatccaaagatattctgaaactgcgcctgtacgagcaacaacacggcaaatgcctgtattcgggcaaagaaatcaacttaggccgtctgaacgaaaaaggctatgtcgaaatcgaccatgccctgccgttctcgcgcacatgggacgacagtttcaacaataaagtactggtattgggcagcgaaaaccaaaacaaaggcaatcaaaccccttacgaatacttcaacggcaaagacaacagccgcgaatggcaggaatttaaagcgcgtgtcgaaaccagccgtttcccgcgcagtaaaaaacaacggattctgctgcaaaaattcgatgaagacggctttaaagaacgcaatctgaacgacacgcgctacgtcaaccgtttcctgtgtcaatttgttgccgaccgtatgcggctgacaggtaaaggcaagaaacgtgtctttgcatccaacggacaaattaccaatctgttgcgcggcttttggggattgcgcaaagtgcgtgcggaaaacgaccgccatcacgccttggacgccgtcgtcgttgcctgctcgaccgttgccatgcagcagaaaattacccgttttgtacgctataaagagatgaacgcgtttgacggtaaaaccatagacaaagaaacaggagaagtgctgcatcaaaaaacacacttcccacaaccttgggaatttttcgcacaagaagtcatgattcgcgtcttcggcaaaccggacggcaaacccgaattcgaagaagccgataccctagaaaaactgcgcacgttgcttgccgaaaaattatcatctcgccccgaagccgtacacgaatacgttacgccactgtttgtttcacgcgcgcccaatcggaagatgagcgggcaagggcatatggagaccgtcaaatccgccaaacgactggacgaaggcgtcagcgtgttgcgcgtaccgctgacacagttaaaactgaaagacttggaaaaaatggtcaatcgggagcgcgaacctaagctatacgaagcactgaaagcacggctggaagcacataaagacgatcctgccaaagcctttgccgagccgttttacaaatacgataaagcaggcaaccgcacccaacaggtaaaagccgtacgcgtagagcaagtacagaaaaccggcgtatgggtgcgcaaccataacggtattgccgacaacgcaaccatggtgcgcgtagatgtgtttgagaaaggcgacaagtattatctggtaccgatttacagttggcaggtagcgaaagggattttgccggatagggctgttgtacaaggaaaagatgaagaagattggcaacttattgatgatagtttcaactttaaattctcattacaccctaatgatttagtcgaggttataacaaaaaaagctagaatgtttggttactttgccagctgccatcgaggcacaggtaatatcaatatacgcattcatgatcttgatcataaaattggcaaaaatggaatactggaaggtatcggcgtcaaaaccgccctttcattccaaaaataccaaattgacgaactgggcaaagaaatcagaccatgccgtctgaaaaaacgcccgcctgtccgttacccatacgatgttccagattacgctgcagctccagcagcgaagaaaaagaagctggattaa

SEQ ID NO: 304 - protein, 1053 aa, Staphylococcus aureus; identical to SEQ ID NO: 26

SEQ ID NO: 305 - protein, 1368 aa, Streptococcus pyogenes [sequence omitted]

SEQ ID NO: 306 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 307 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 308 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 309 - protein, 1397 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 310 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 311 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 312 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 313 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 314 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 315 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 316 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 317 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 318 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 319 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 320 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 321 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 322 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 323 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 324 - protein, 1368 aa, Streptococcus pyogenes [sequence omitted]

SEQ ID NO: 325 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 326 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 327 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 328 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 329 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 330 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 331 - protein, 1472 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 332 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 333 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 334 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 335 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 336 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 337 - protein, 1517 aa, Bacteroides sp.
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 338 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 339 - protein, 1424 aa, Prevotella sp.
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 340 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 341 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 342 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 343 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 344 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 345 - protein, 1197 aa, Porphyromonas sp.
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 346 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 347 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 348 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 349 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 350 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 351 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 352 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 353 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 354 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 355 - protein, 1181 aa, Actinomyces sp.
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 356 - protein, 1113 aa, Alcanivorax sp.
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 357 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 358 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 359 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 360 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 361 - protein, 1082 aa, Neisseria meningitidis; identical to SEQ ID NO: 25

SEQ ID NO: 362 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 363 - protein, 1059 aa, Rhodovulum sp.
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 364 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 365 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 366 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 367 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 368 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 369 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 370 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 371 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 372 - protein, 1061 aa, Treponema sp.
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 373 - protein, 1011 aa, Unknown
  Uncultured delta polypeptide
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 374 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 375 - protein, 1168 aa, Azospirillum sp.
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 376 - protein, 1064 aa, Bradyrhizobium sp.
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 377 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 378 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 379 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 380 - protein, 1035 aa, Puniceispirillum marinum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 381 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 382 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 383 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 384 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 385 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 386 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 387 - DNA, 22 bp, Artificial Sequence
  Synthetic
gacactgccaatagggataggt

SEQ ID NO: 388 - DNA, 22 bp, Artificial Sequence
  Synthetic
gtcaaaagctaccggttacctg

SEQ ID NO: 389 - DNA, 22 bp, Artificial Sequence
  Synthetic
gttctgtcctcagtaaaaggta

SEQ ID NO: 390 - DNA, 20 bp, Artificial Sequence
  Synthetic
gaatagtttgttctgggtac

SEQ ID NO: 391 - DNA, 20 bp, Artificial Sequence
  Synthetic
gagaaagggatgggcactta

SEQ ID NO: 392 - DNA, 20 bp, Artificial Sequence
  Synthetic
gatgcagaactagtgtagac

SEQ ID NO: 393 - DNA, 20 bp, Artificial Sequence
  Synthetic
gtcacatgggagtcacaggg

SEQ ID NO: 394 - DNA, 19 bp, Artificial Sequence
  Synthetic
gagtatctcctgtttggca

SEQ ID NO: 395 - RNA, 20 nt, Artificial Sequence
  Synthetic
gagauacucacaauuacaac

SEQ ID NO: 396 - RNA, 20 nt, Artificial Sequence
  Synthetic
gauacucacaauuacaacug

SEQ ID NO: 397 - RNA, 17 nt, Artificial Sequence
  Synthetic
gauacucacaauuacaa

SEQ ID NO: 398 - RNA, 22 nt, Artificial Sequence
  Synthetic
gcaccuggccccaguuguaauu

SEQ ID NO: 399 - DNA, 25 bp, Artificial Sequence
  Synthetic
aacatgctacgcagagagggagtgg

SEQ ID NO: 400 - DNA, 29 bp, Artificial Sequence
  Synthetic
catgagacaaggaacccctagtgatggag

SEQ ID NO: 401 - DNA, 617 bp, Artificial Sequence
  Synthetic
cattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgc

SEQ ID NO: 402 - DNA, 252 bp, Artificial Sequence
  Synthetic
tcgagtggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaccgcgg

SEQ ID NO: 403 - DNA, 292 bp, Artificial Sequence
  Synthetic
gggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttcgcctggtgctgtgtcagccccggtctcccaggggcttcccagtggtccccaggaaccctcgacagggcccggtctctctcgtccagcaagggcagggacgggccacaggccaagggc

SEQ ID NO: 404 - DNA, 113 bp, Artificial Sequence
  Synthetic
gcctgtagccttaatctctcctagcagggggtttgggggagggaggaggagaaagaaagggccccttatggctgagacacaatgacccagccacaaggagggattaccgggcg

SEQ ID NO: 405 - DNA, 281 bp, Artificial Sequence
  Synthetic
aggtaggaagtggcctttaactccatagaccctatttaaacagcttcggacaggtttaaacatctccttggataattcctagtatccctgttcccactcctactcagggatgatagctctaagaggtgttaggggattaggctgaaaatgtaggtcacccctcagccatctgggaactagaatgagtgagagaggagagaggggcagagacacacacattcgcatattaaggtgacgcgtgtggcctcgaacaccgagcgaccctgcagcgacccgcttaa

SEQ ID NO: 406 - DNA, 235 bp, Artificial Sequence
  Synthetic
attttaatctcactagggttctgggagcacccccccccaccgctcccgccctccacaaagctcctgggcccctcctcccttcaaggattgcgaagagctggtcgcaaatcctcctaagccaccagcatctcggtcttcagctcacaccagccttgagcccagcctgcggccaggggaccacgcacgtcccacccacccagcgactccccagccgctgcccactcttcctcactca

SEQ ID NO: 407 - DNA, 143 bp, Artificial Sequence
  Synthetic
ttgcccactccctctctgcgcgctcgctcgctcggtggggcctgcggaccaaaggtccgcagacggcagagctctgctctgccggccccaccgagcgagcgagcgcgcagagagggagtgggcaactccatcactaggggtaa

SEQ ID NO: 408 - DNA, 145 bp, Artificial Sequence
  Synthetic
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcct

SEQ ID NO: 409 - DNA, 142 bp, Artificial Sequence
  Synthetic
tggccactccctctatgcgcactcgctcgctcggtggggcctggcgaccaaaggtcgccagacggacgtgctttgcacgtccggccccaccgagcgagcgagtgcgcatagagggagtggccaactccatcactagaggtat

SEQ ID NO: 410 - DNA, 146 bp, Artificial Sequence
  Synthetic
ttggccactccctctatgcgcgctcgctcactcactcggccctggagaccaaaggtctccagactgccggcctctggccggcagggccgagtgagtgagcgagcgcgcatagagggagtggccaactccatcatctaggtttgccc

SEQ ID NO: 411 - DNA, 155 bp, Artificial Sequence
  Synthetic
ctctcccccctgtcgcgttcgctcgctcgctggctcgtttgggggggtggcagctcaaagagctgccagacgacggccctctggccgtcgcccccccaaacgagccagcgagcgagcgaacgcgacaggggggagagtgccacactctcaagcaa

SEQ ID NO: 412 - DNA, 143 bp, Artificial Sequence
  Synthetic
atacccctagtgatggagttgcccactccctctatgcgcgctcgctcgctcggtggggccggcagagcagagctctgccgtctgcggacctttggtccgcaggccccaccgagcgagcgagcgcgcatagagggagtgggcaa

SEQ ID NO: 413 - DNA, 145 bp, Artificial Sequence
  Synthetic
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccg

SEQ ID NO: 414 - DNA, 145 bp, Artificial Sequence
  Synthetic
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacacc

SEQ ID NO: 415 - DNA, 145 bp, Artificial Sequence
  Synthetic
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacac

SEQ ID NO: 416 - DNA, 19 bp, Artificial Sequence
  Synthetic
cagatctgaattcggtacc

SEQ ID NO: 417 - DNA, 264 bp, Artificial Sequence
  Synthetic
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacc

SEQ ID NO: 418 - DNA, 82 bp, Artificial Sequence
  Synthetic
gttttagtactctggaaacagaatctactaaaacaaggcaaaatgccgtgtttatctcgtcaacttgttggcgagatttttt

SEQ ID NO: 419 - DNA, 50 bp, Artificial Sequence
  Synthetic
ggtaccgctagcgcttaagtcgcgatgtacgggccagatatacgcgttga

SEQ ID NO: 420 - DNA, 30 bp, Artificial Sequence
  Synthetic
ccgaagaaaaagcgcaaggtcgaagcgtcc

SEQ ID NO: 421 - DNA, 3159 bp, Artificial Sequence; identical to SEQ ID NO: 39
  Synthetic

SEQ ID NO: 422 - DNA, 21 bp, Artificial Sequence
  Synthetic
cccaagaagaagaggaaagtc

SEQ ID NO: 423 - DNA, 66 bp, Artificial Sequence
  Synthetic
gactacaaagaccatgacggtgattataaagatcatgacatcgattacaaggatgacgatgacaag

SEQ ID NO: 424 - DNA, 60 bp, Artificial Sequence
  Synthetic
tagcaataaaggatcgtttattttcattggaagcgtgtgttggttttttgatcaggcgcg

SEQ ID NO: 425 - DNA, 86 bp, Artificial Sequence
  Synthetic
tccaagcttcgcaggaaagaacatgtgagcaaaaggccagcaaaaggcgttaactctagatttaaatgcatgctggggagagatct

SEQ ID NO: 426 - protein, 22 aa, Artificial Sequence
  Synthetic
DYKDHDGDYKDHDIDYKDDDDK

SEQ ID NO: 427 - DNA, 20 bp, Artificial Sequence
  Synthetic
cgacttagttcgatcgaagg

SEQ ID NO: 428 - DNA, 5217 bp, Artificial Sequence
  Synthetic
  misc_feature (429)..(454): n is a, c, g, or t
  misc_feature (821)..(846): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcgcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 429 - DNA, 4870 bp, Artificial Sequence
  Synthetic
  misc_feature (429)..(454): n is a, c, g, or t
  misc_feature (821)..(846): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagttcgagtggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaccgcgggcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 430 - DNA, 4910 bp, Artificial Sequence
  Synthetic
  misc_feature (429)..(454): n is a, c, g, or t
  misc_feature (821)..(846): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagtgggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttcgcctggtgctgtgtcagccccggtctcccaggggcttcccagtggtccccaggaaccctcgacagggcccggtctctctcgtccagcaagggcagggacgggccacaggccaagggcgcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 431 - DNA, 4731 bp, Artificial Sequence
  Synthetic
  misc_feature (429)..(454): n is a, c, g, or t
  misc_feature (821)..(846): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagtgcctgtagccttaatctctcctagcagggggtttgggggagggaggaggagaaagaaagggccccttatggctgagacacaatgacccagccacaaggagggattaccgggcggcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 432 - DNA, 4899 bp, Artificial Sequence
  Synthetic
  misc_feature (429)..(454): n is a, c, g, or t
  misc_feature (821)..(846): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagtaggtaggaagtggcctttaactccatagaccctatttaaacagcttcggacaggtttaaacatctccttggataattcctagtatccctgttcccactcctactcagggatgatagctctaagaggtgttaggggattaggctgaaaatgtaggtcacccctcagccatctgggaactagaatgagtgagagaggagagaggggcagagacacacacattcgcatattaaggtgacgcgtgtggcctcgaacaccgagcgaccctgcagcgacccgcttaagcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 433 - DNA, 4853 bp, Artificial Sequence
  Synthetic
  misc_feature (429)..(454): n is a, c, g, or t
  misc_feature (821)..(846): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctcagatctgaattcggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttcgacttagttcgatcgaaggaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnnnnnnnnngttttagtactctggaaacagaatctactaaaacaaggcaaaatgccgtgtttatctcgtcaacttgttggcgagattttttggtaccgctagcgcttaagtcgcgatgtacgggccagatatacgcgttgacattgattattgactagtattttaatctcactagggttctgggagcacccccccccaccgctcccgccctccacaaagctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactcagcggccgctaatacgactcactatagggagagccgccaccatgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggcggatcccccaagaagaagaggaaagtctcgagcgactacaaagaccatgacggtgattataaagatcatgacatcgattacaaggatgacgatgacaagtagcaataaaggatcgtttattttcattggaagcgtgtgttggttttttgatcaggcgcgtccaagcttcgcaggaaagaacatgtgagcaaaaggccagcaaaaggcgttaactctagatttaaatgcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 434 - protein, 7 aa, Artificial Sequence
  Synthetic
PKKKRKV

SEQ ID NO: 435 - protein, 1053 aa, Artificial Sequence; identical to SEQ ID NO: 26
  Synthetic

SEQ ID NO: 436 - DNA, 143 bp, Artificial Sequence
  Synthetic
ttacccctagtgatggagttgcccactccctctctgcgcgctcgctcgctcggtggggccggcagagcagagctctgccgtctgcggacctttggtccgcaggccccaccgagcgagcgagcgcgcagagagggagtgggcaa

SEQ ID NO: 437 - DNA, 145 bp, Artificial Sequence
  Synthetic
aggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 438 - DNA, 142 bp, Artificial Sequence
  Synthetic
atacctctagtgatggagttggccactccctctatgcgcactcgctcgctcggtggggccggacgtgcaaagcacgtccgtctggcgacctttggtcgccaggccccaccgagcgagcgagtgcgcatagagggagtggcca

SEQ ID NO: 439 - DNA, 146 bp, Artificial Sequence
  Synthetic
gggcaaacctagatgatggagttggccactccctctatgcgcgctcgctcactcactcggccctgccggccagaggccggcagtctggagacctttggtctccagggccgagtgagtgagcgagcgcgcatagagggagtggccaa

SEQ ID NO: 440 - DNA, 155 bp, Artificial Sequence
  Synthetic
ttgcttgagagtgtggcactctcccccctgtcgcgttcgctcgctcgctggctcgtttgggggggcgacggccagagggccgtcgtctggcagctctttgagctgccacccccccaaacgagccagcgagcgagcgaacgcgacaggggggagag

SEQ ID NO: 441 - DNA, 143 bp, Artificial Sequence
  Synthetic
ttgcccactccctctatgcgcgctcgctcgctcggtggggcctgcggaccaaaggtccgcagacggcagagctctgctctgccggccccaccgagcgagcgagcgcgcatagagggagtgggcaactccatcactaggggtat

SEQ ID NO: 442 - DNA, 145 bp, Artificial Sequence
  Synthetic
cggtacccctagtgatggagttggccactccctctatgcgcgctcgctcgctcggtggggccggcagagcagagctctgccgtctgcggacctttggtccgcaggccccaccgagcgagcgagcgcgcatagagggagtggccaa

SEQ ID NO: 443 - DNA, 145 bp, Artificial Sequence
  Synthetic
ggtgtcgcaaaatgccgcaaaagcactcacgtgacagctaatacaggaccactcccctatgacgtaatttacgtcagcgctgacgcggcagcgtgggaggcgcttcgcgctacccctagtgatggagttggccactccctctctg

SEQ ID NO: 444 - DNA, 145 bp, Artificial Sequence
  Synthetic
gtgtcgcaaaatgtcgcaaaagcactcacgtgacagctaatacaggaccactcccctatgacgtaatctacgtcagcgctgacgcggcagcgtgggaggcgcttcgcgattacccctagtgatggagttggccactccctctctg

SEQ ID NO: 445 - DNA, 5217 bp, Artificial Sequence
  Synthetic
  misc_feature (4372)..(4397): n is a, c, g, or t
  misc_feature (4764)..(4789): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgcgcggatctctagcggatctgacggttcactaaaccagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 446 - DNA, 4870 bp, Artificial Sequence
  Synthetic
  misc_feature (4025)..(4050): n is a, c, g, or t
  misc_feature (4417)..(4442): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgcccgcggtcacgacacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagccactcgaactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 447 - DNA, 4862 bp, Artificial Sequence
  Synthetic
  misc_feature (4409)..(4434): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgcgcccttggcctgtggcccgtccctgcccttgctggacgagagagaccgggccctgtcgagggttcctggggaccactgggaagcccctgggagaccggggctgacacagcaccaggcgaaatcccagccggggtcacggaggacgcttaggagtggcaagaaggtgctagaaaaagacaatcccctgagctgcttggaatccgattagatcattctgcccggccccttcctccaaggggccgcctcacttttcccctgagaaggacaaacaaccaccaggcttctggggcccactagtcaataatcaatgtcaacgcgtatatctggcccgtacatcgcgacttaagcgctagcggtaccaaaaaatctcgccaacaagttgacgagataaacacggcattttgccttgttttagtagatggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 448 - DNA, 4731 bp, Artificial Sequence
  Synthetic
  misc_feature (3886)..(3911): n is a, c, g, or t
  misc_feature (4278)..(4303): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgccgcccggtaatccctccttgtggctgggtcattgtgtctcagccataaggggccctttctttctcctcctccctcccccaaaccccctgctaggagagattaaggctacaggcactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 449 - DNA, 4899 bp, Artificial Sequence
  Synthetic
  misc_feature (4054)..(4079): n is a, c, g, or t
  misc_feature (4446)..(4471): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgcttaagcgggtcgctgcagggtcgctcggtgttcgaggccacacgcgtcaccttaatatgcgaatgtgtgtgtctctgcccctctctcctctctcactcattctagttcccagatggctgaggggtgacctacattttcagcctaatcccctaacacctcttagagctatcatccctgagtaggagtgggaacagggatactaggaattatccaaggagatgtttaaacctgtccgaagctgtttaaatagggtctatggagttaaaggccacttcctacctactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 450 - DNA, 4853 bp, Artificial Sequence
  Synthetic
  misc_feature (4008)..(4033): n is a, c, g, or t
  misc_feature (4400)..(4425): n is a, c, g, or t
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctctccccagcatgcatttaaatctagagttaacgccttttgctggccttttgctcacatgttctttcctgcgaagcttggacgcgcctgatcaaaaaaccaacacacgcttccaatgaaaataaacgatcctttattgctacttgtcatcgtcatccttgtaatcgatgtcatgatctttataatcaccgtcatggtctttgtagtcgctcgagactttcctcttcttcttgggggatccgccctttttgataatctgagggtgctttttgctcttcacctcatacaggtttcccagaatgtcggttgagtactttttgatactctgagtcttagaggcaattgttttgataattcgaggggggcgcttatcattcatgttttccagatactctcggtaagtgatgtcaatcatattcacttcaatgcggttcagcagatcattgttcaccccgatgaccctatacagttcgccattgatcttaatcaggtcgttgttgtaaaaggaggcgatgaactctgcctggttgctaatctttttcagctttttagcctcttcgtagcacttgctattcacttcatagtagttctcctttttgatgacatccagattcttgacagtcacaaatttatacacgccgttgtccagatagacatcgaatctgtatggcttcagtgacagcttgaccaccttgttgcgactgttagggtaatcgtctgtgatgtccagatgggcattcagcttgttcccatagtacttgatcttcttgatcacggggccattatcctttttgctatacttggtcaggtagttcccagtctcttcatagtacttatacagtgggttcttctcgtcgccgtactgctccataatcagcttcagtttctgatatgtctgaggatcatggtggtacatcagcagcttctcgggacttttgttgatcagctttttcagcttgtcattatctttgtcgtacagtccgttcagattgttcacaatcagggtattccccttatcgtcttttcttgtactatacagggtgtcattgatcagctctctgttgggctttttatccacccggtgagagtacttgtagtccttgaaatccttgatatgcttgatctggtgaggagtgatgaaaatctccttgtactcctgttctgtctcgatttcgggcatagattcggcctgcttctcttcgaacatctggttctccatcactttcttggctttgtccagctttttccactccttaaagatgaagtcggcatttgcgataatcagagcatcttcggcatggtgcttgtaccctttgttgcgctcctttttaaacttccatttgcgcctcagaaaagatgtgaacccgccgttgatggacttgactttcacatccagattgttcacccggaaataggatcgcagcagattcatcaggccgcgagtagcgtatcttgtgtccaccagattccggttaataaaatccttctggacggagaatctgttgatgtcccgctcttccagcaggtactcctttttggtcttgctgatgcggccctttcctttggccagattcagaatgtgctttttaaaggtttcgtaagagatcttggaatctgaactagacaggtactggaaaggagtcctattgccctttttagagttctcttcctgcttgaccagcaccttgttgttaaaggaattgtcgaaggacacgcttctggggataatatgatcgacctcgtagttgaatggattgttcagcaggtcctccagggggatggcctccagagaatacagacactttccctcctgcatatcgtgcagcttgattttttcaatcaggtactttgcgttctctttcccggtagttcggataatctcttcaatgcgttcattggtctgccggtttcgtttctgcatctcattgatcatcttctgtgcgtccttgctgttcttctccctagccagctcgataatgatatcattgggcaggccgtacttcttgatgatggcgttgatcactttgatgctctggatgaagctccgcttgaccacgggtgacagaatgaaatcgtccaccagtgtggttgggatctctttctgctgactcaggtccaccttttttgggaccagcttcagccggttaaagattgcaatctgattgtcgtttgtatgccacagctcatccagaatcagattgatagctttcagggacaggttgtgtgttccggtgtaccccttcagattactaatctgttcgatctcttcctgggtcagctcgctgttcaggttagtcagctcttcctggatgtcctcggagctctggtagatagtcaggatcttagcaatctgatccagcagttcggcgttctcaatgatttctttccgtgctgtgatgtccttaatatcgtgatacactttcagattggtgaactctggttttccagtgcttgtcacccggtagcccttgatgtcctcttcgttgaccaggatctccttagcaatctgtttcagtgtaggctttttcttctgcttaaacacgttttcgatgatctggaacttctcatagtattccagtttctcgttttcatccctggtgatgaccaggttgttcaggtcattcagggcgttgtacagatctgcgttataagcgtacttgacgcttctcagctcttctggaaaataggtgcaatgtcccatcagcatctcgtaccattccttgatgtctttccatccgaaggggctcccttctcctggtccctcatagtaggttctccgagtctccagcaggtcgatataagtatcgatgaagctctgatccagctggtggtaagccttctgcactttcagcagctgcttggcttctttgacgtagtcgcttgtcttgaacctattaattgaccctctcacctcgccatctttcttcagccgttccagctgcagctctgcgacatacttctcttccagagctttgctattgcgtgagatctgttcctttgtagacagctcgttgccggtgtcctcttccacctcattgacgttatgcactcctcggcgcttagccaggtgcagcagagctgcggaaaactcttcctctgacagcttctgactcaggcctttcaccctggcttcataaggattaattccactcagctcagaatggtcggtcagcaggttgtaatcgaacagcagtttcttcaccctctggattctgtgccttctccgtcgtttcaggcgcctggctcccctcttgcttctccgtccctcattgttttccacgttggcctccttgaacagtctgacgcctgcgtcgatcacgtcccttgtttcatagtcaataatcccataccccacgcttgtaatcccgatgtccagccccagaatgtagttccttttcatggacgcttcgaccttgcgctttttcttcggcatggtggcggctctccctatagtgagtcgtattagcggccgctgagtgaggaagagtgggcagcggctggggagtcgctgggtgggtgggacgtgcgtggtcccctggccgcaggctgggctcaaggctggtgtgagctgaagaccgagatgctggtggcttaggaggatttgcgaccagttcttcgcaatccttgaagggaggaggggcccaggagctttgtggagggcgggagcggtgggggggggtgctcccagaaccctagtgagattaaaatactagtcaataatcaatgtcaacgcgtatatctggcccgtacatcgcgacttaagcgctagcggtaccaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttccttcgatcgaactaagtcgaaaaaatctcgccaacaagttgacgagataaacacggcattttgccttgttttagtagattctgtttccagagtactaaaacnnnnnnnnnnnnnnnnnnnnnnnnnnggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattctaattatctctctaacagccttgtatcgtatatgcaaatatgaaggaatcatgggaaataggccctcttcctgcccgaccttggtaccgaattcagatctgaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 451 - protein, 8 aa, Artificial Sequence
  Synthetic
DYKDDDDK

SEQ ID NO: 452 - protein, 9 aa, Artificial Sequence
  Synthetic
YPYDVPDYA

SEQ ID NO: 453 - protein, 10 aa, Artificial Sequence
  Synthetic
EQKLISEEDL

SEQ ID NO: 454 - protein, 6 aa, Artificial Sequence
  Synthetic
HHHHHH

SEQ ID NO: 455 - DNA, 228 bp, Artificial Sequence
  Synthetic
gctgcaggatgaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggaca

SEQ ID NO: 456 - DNA, 134 bp, Artificial Sequence
  Synthetic
atgctttatttgtgaaatttgtgatgctattgctttatttgtaaccattataagctgcaataaacaagttaacaacaacaattgcattcattttatgtttcaggttcagggggaggtgtgggaggttttttaaa

SEQ ID NO: 457 - RNA, 17 nt, Artificial Sequence
  Synthetic
gcuaccgguuaccugaa

SEQ ID NO: 458 - RNA, 17 nt, Artificial Sequence
  Synthetic
gcagaacuaguguagac

SEQ ID NO: 459 - RNA, 17 nt, Artificial Sequence
  Synthetic
guugaguaucuccuguu

SEQ ID NO: 460 - RNA, 20 nt, Artificial Sequence
  Synthetic
gaugcagaacuaguguagac

SEQ ID NO: 461 - RNA, 20 nt, Artificial Sequence
  Synthetic
gcuugaacucugugccaaac

SEQ ID NO: 462 - RNA, 20 nt, Artificial Sequence
  Synthetic
gaaagaugaaaaauacucuu

SEQ ID NO: 463 - RNA, 17 nt, Artificial Sequence
  Synthetic
gaaauagauguagauug

SEQ ID NO: 464 - RNA, 20 nt, Artificial Sequence
  Synthetic
gaaauauuaagggcucuucc

SEQ ID NO: 465 - RNA, 20 nt, Artificial Sequence
  Synthetic
gaacaaaagccagggaccau

SEQ ID NO: 466 - RNA, 20 nt, Artificial Sequence
  Synthetic
gaacucuauaccuuuuacug

SEQ ID NO: 467 - RNA, 20 nt, Artificial Sequence
  Synthetic
gaagaauggaauagauaaua

SEQ ID NO: 468 - RNA, 20 nt, Artificial Sequence
  Synthetic
gaauaguuuguucuggguac

SEQ ID NO: 469 - RNA, 17 nt, Artificial Sequence
  Synthetic
gaauggaauagauaaua

SEQ ID NO: 470 - RNA, 20 nt, Artificial Sequence
  Synthetic
gaauuuacagagugcaucca

SEQ ID NO: 471 - RNA, 20 nt, Artificial Sequence
  Synthetic
gagaaaaaggagcaugaaac

SEQ ID NO: 472 - RNA, 17 nt, Artificial Sequence
  Synthetic
gagagccacagugcaug

SEQ ID NO: 473 - RNA, 17 nt, Artificial Sequence
  Synthetic
gagguagaaucaagaag

SEQ ID NO: 474 - RNA, 17 nt, Artificial Sequence
  Synthetic
gagugcauccauggucc

SEQ ID NO: 475 - RNA, 17 nt, Artificial Sequence
  Synthetic
gauaacuacaaaggguc

SEQ ID NO: 476 - RNA, 17 nt, Artificial Sequence
  Synthetic
gauagagacaggaauaa

SEQ ID NO: 477 - RNA, 17 nt, Artificial Sequence
  Synthetic
gaugaaaaauacucuuu

SEQ ID NO: 478 - RNA, 17 nt, Artificial Sequence
  Synthetic
gaugacaugagguaagu

SEQ ID NO: 479 - RNA, 17 nt, Artificial Sequence
  Synthetic
gcauguggugucaaaua

SEQ ID NO: 480 - RNA, 20 nt, Artificial Sequence
  Synthetic
gccugaacaaguuuugaaac

SEQ ID NO: 481 - RNA, 17 nt, Artificial Sequence
  Synthetic
gcucuuuucuauauaua

SEQ ID NO: 482 - RNA, 20 nt, Artificial Sequence
  Synthetic
gcuuuugacaguuuuuaagg

SEQ ID NO: 483 - RNA, 17 nt, Artificial Sequence
  Synthetic
gcuuuuguuccuuggaa

SEQ ID NO: 484 - RNA, 20 nt, Artificial Sequence
  Synthetic
ggaacaaaagccagggacca

SEQ ID NO: 485 - RNA, 20 nt, Artificial Sequence
  Synthetic
ggacuugacuuuuacccuuc

SEQ ID NO: 486 - RNA, 17 nt, Artificial Sequence
  Synthetic
ggagaauaguuuguucu

SEQ ID NO: 487 - RNA, 20 nt, Artificial Sequence
  Synthetic
ggagucacaugggagucaca

SEQ ID NO: 488 - RNA, 17 nt, Artificial Sequence
  Synthetic
ggauaggacagaggaca

SEQ ID NO: 489 - RNA, 20 nt, Artificial Sequence
  Synthetic
ggcuguaagauaacuacaaa

SEQ ID NO: 490 - RNA, 17 nt, Artificial Sequence
  Synthetic
gggagaauaguuuguuc

SEQ ID NO: 491 - RNA, 20 nt, Artificial Sequence
  Synthetic
gggagucacaugggagucac

SEQ ID NO: 492 - RNA, 17 nt, Artificial Sequence
  Synthetic
gggcucuuccuggacca

SEQ ID NO: 493 - RNA, 20 nt, Artificial Sequence
  Synthetic
ggguacagggguaagagaaa

SEQ ID NO: 494 - RNA, 20 nt, Artificial Sequence
  Synthetic
ggucccuggcuuuuguuccu

SEQ ID NO: 495 - RNA, 20 nt, Artificial Sequence
  Synthetic
guaaagguucaugagacuag

SEQ ID NO: 496 - RNA, 20 nt, Artificial Sequence
  Synthetic
guaacauaaucaccucucuu

SEQ ID NO: 497 - RNA, 20 nt, Artificial Sequence
  Synthetic
guaagacuggagauagagac

SEQ ID NO: 498 - RNA, 17 nt, Artificial Sequence
  Synthetic
guacagggguaagagaa

SEQ ID NO: 499 - RNA, 20 nt, Artificial Sequence
  Synthetic
guagcuuuugacaguuuuua

SEQ ID NO: 500 - RNA, 17 nt, Artificial Sequence
  Synthetic
gucacaugggagucaca

SEQ ID NO: 501 - RNA, 20 nt, Artificial Sequence
  Synthetic
guggagagccacagugcaug

SEQ ID NO: 502 - RNA, 17 nt, Artificial Sequence
  Synthetic
guuacaaucugugaaua

SEQ ID NO: 503 - RNA, 17 nt, Artificial Sequence
  Synthetic
guucuguccucaguaaa

SEQ ID NO: 504 - RNA, 20 nt, Artificial Sequence
  Synthetic
guuuagaaugaucauucuug

SEQ ID NO: 505 - RNA, 17 nt, Artificial Sequence
  Synthetic
guuuguucuggguacag

SEQ ID NO: 506 - RNA, 20 nt, Artificial Sequence
  Synthetic
uaaaaacugucaaaagcuac

SEQ ID NO: 507 - RNA, 20 nt, Artificial Sequence
  Synthetic
uaaaagguauagaguucaag

SEQ ID NO: 508 - RNA, 20 nt, Artificial Sequence
  Synthetic
uaaaucaugcaagugaccua

SEQ ID NO: 509 - RNA, 20 nt, Artificial Sequence
  Synthetic
uaagauaacuacaaaggguc

SEQ ID NO: 510 - RNA, 17 nt, Artificial Sequence
  Synthetic
gaauccugaaagcuacu

SEQ ID NO: 511 - RNA, 24 nt, Artificial Sequence
  Synthetic
gcuaaaucaugcaagugaccuaag

SEQ ID NO: 512 - RNA, 19 nt, Artificial Sequence
  Synthetic
ggucacuugcaugauuuag

SEQ ID NO: 513 - RNA, 18 nt, Artificial Sequence
  Synthetic
gucacuugcaugauuuag

SEQ ID NO: 514 - RNA, 23 nt, Artificial Sequence
  Synthetic
gccuaggacuuucuaaugcugga

SEQ ID NO: 515 - RNA, 18 nt, Artificial Sequence
  Synthetic
ggacuuucuaaugcugga

SEQ ID NO: 516 - RNA, 24 nt, Artificial Sequence
  Synthetic
gggaccaugggagaauaguuuguu

SEQ ID NO: 517 - RNA, 23 nt, Artificial Sequence
  Synthetic
ggaccaugggagaauaguuuguu

SEQ ID NO: 518 - RNA, 22 nt, Artificial Sequence
  Synthetic
gaccaugggagaauaguuuguu

SEQ ID NO: 519 - RNA, 24 nt, Artificial Sequence
  Synthetic
ggucccuggcuuuuguuccuugga

SEQ ID NO: 520 - RNA, 23 nt, Artificial Sequence
  Synthetic
gucccuggcuuuuguuccuugga

SEQ ID NO: 521 - RNA, 24 nt, Artificial Sequence
  Synthetic
gaaaacguuguucugaguagcuuu

SEQ ID NO: 522 - RNA, 18 nt, Artificial Sequence
  Synthetic
guuguucugaguagcuuu

SEQ ID NO: 523 - RNA, 19 nt, Artificial Sequence
  Synthetic
gucccuggcuuuuguuccu

SEQ ID NO: 524 - RNA, 23 nt, Artificial Sequence
  Synthetic
gacaucuuguggauaauguauca

SEQ ID NO: 525 - RNA, 21 nt, Artificial Sequence
  Synthetic
guccuaggcaagagacaucuu

SEQ ID NO: 526 - RNA, 23 nt, Artificial Sequence
  Synthetic
gccagcaaaagcuuuugagcuaa

SEQ ID NO: 527 - RNA, 19 nt, Artificial Sequence
  Synthetic
gcaaaagcuuuugagcuaa

SEQ ID NO: 528 - RNA, 21 nt, Artificial Sequence
  Synthetic
gaucuuauucuacuccuguga

SEQ ID NO: 529 - RNA, 23 nt, Artificial Sequence
  Synthetic
gcuuucaggauuccuacuaaauu

SEQ ID NO: 530 - RNA, 22 nt, Artificial Sequence
  Synthetic
guucuguccucaguaaaaggua

SEQ ID NO: 531 - RNA, 18 nt, Artificial Sequence
  Synthetic
gaacaacguuuucauuua

SEQ ID NO: 532 - RNA, 24 nt, Artificial Sequence
  Synthetic
guagaauaucauaaguuacaaucu

SEQ ID NO: 533 - RNA, 21 nt, Artificial Sequence
  Synthetic
gaauaucauaaguuacaaucu

SEQ ID NO: 534 - RNA, 20 nt, Artificial Sequence
  Synthetic
guggcuguaagauaacuaca

SEQ ID NO: 535 - RNA, 18 nt, Artificial Sequence
  Synthetic
ggcuguaagauaacuaca

SEQ ID NO: 536 - RNA, 22 nt, Artificial Sequence
  Synthetic
guuuaacguuaucauuuuccca

SEQ ID NO: 537 - RNA, 24 nt, Artificial Sequence
  Synthetic
guaagagaaagggaugggcacuua

SEQ ID NO: 538 - RNA, 20 nt, Artificial Sequence
  Synthetic
gagaaagggaugggcacuua

SEQ ID NO: 539 - RNA, 18 nt, Artificial Sequence
  Synthetic
gaaagggaugggcacuua

SEQ ID NO: 540 - RNA, 18 nt, Artificial Sequence
  Synthetic
guaaaugaaaacguuguu

SEQ ID NO: 541 - RNA, 24 nt, Artificial Sequence
  Synthetic
gauaaacaugacucauaauuuagu

SEQ ID NO: 542 - RNA, 23 nt, Artificial Sequence
  Synthetic
ggaacaaaagccagggaccaugg

SEQ ID NO: 543 - RNA, 22 nt, Artificial Sequence
  Synthetic
gaacaaaagccagggaccaugg

SEQ ID NO: 544 - RNA, 24 nt, Artificial Sequence
  Synthetic
gggagaauaguuuguucuggguac

SEQ ID NO: 545 - RNA, 23 nt, Artificial Sequence
  Synthetic
ggagaauaguuuguucuggguac

SEQ ID NO: 546 - RNA, 22 nt, Artificial Sequence
  Synthetic
gagaauaguuuguucuggguac

SEQ ID NO: 547 - RNA, 20 nt, Artificial Sequence
  Synthetic
gaaauagaggcuuauggauu

SEQ ID NO: 548 - RNA, 24 nt, Artificial Sequence
  Synthetic
guucuggguacagggguaagagaa

SEQ ID NO: 549 - RNA, 19 nt, Artificial Sequence
  Synthetic
ggguacagggguaagagaa

SEQ ID NO: 550 - RNA, 18 nt, Artificial Sequence
  Synthetic
gguacagggguaagagaa

SEQ ID NO: 551 - RNA, 24 nt, Artificial Sequence
  Synthetic
guaaauucucaucauuuuuuauug

SEQ ID NO: 552 - RNA, 24 nt, Artificial Sequence
  Synthetic
ggagaggauaggacagaggacaug

SEQ ID NO: 553 - RNA, 23 nt, Artificial Sequence
  Synthetic
gagaggauaggacagaggacaug

SEQ ID NO: 554 - RNA, 21 nt, Artificial Sequence
  Synthetic
gaggauaggacagaggacaug

SEQ ID NO: 555 - RNA, 19 nt, Artificial Sequence
  Synthetic
ggauaggacagaggacaug

SEQ ID NO: 556 - RNA, 18 nt, Artificial Sequence
  Synthetic
gauaggacagaggacaug

SEQ ID NO: 557 - RNA, 22 nt, Artificial Sequence
  Synthetic
gaauaaauguagaauuuuaaug

SEQ ID NO: 558 - RNA, 22 nt, Artificial Sequence
  Synthetic
gucaaaagcuaccgguuaccug

SEQ ID NO: 559 - RNA, 23 nt, Artificial Sequence
  Synthetic
guuuuuaaggcggggagucacau

SEQ ID NO: 560 - RNA, 24 nt, Artificial Sequence
  Synthetic
gucuuacauccuccuuacugccac

SEQ ID NO: 561 - RNA, 24 nt, Artificial Sequence
  Synthetic
gagucacaggguaggauucauguu

SEQ ID NO: 562 - RNA, 22 nt, Artificial Sequence
  Synthetic
gucacaggguaggauucauguu

SEQ ID NO: 563 - RNA, 24 nt, Artificial Sequence
  Synthetic
ggcacagaguucaagcuaauacau

SEQ ID NO: 564 - RNA, 23 nt, Artificial Sequence
  Synthetic
gcacagaguucaagcuaauacau

SEQ ID NO: 565 - RNA, 18 nt, Artificial Sequence
  Synthetic
gaguucaagcuaauacau

SEQ ID NO: 566 - RNA, 24 nt, Artificial Sequence
  Synthetic
guguugaguaucuccuguuuggca

SEQ ID NO: 567 - RNA, 22 nt, Artificial Sequence
  Synthetic
guugaguaucuccuguuuggca

SEQ ID NO: 568 - RNA, 19 nt, Artificial Sequence
  Synthetic
gaguaucuccuguuuggca

SEQ ID NO: 569 - RNA, 21 nt, Artificial Sequence
  Synthetic
gaaaaucagauuucaugugug

SEQ ID NO: 570 - RNA, 24 nt, Artificial Sequence
  Synthetic
gccacaagaaugaucauucuaaac

SEQ ID NO: 571 - RNA, 23 nt, Artificial Sequence
  Synthetic
ggcggggagucacaugggaguca

SEQ ID NO: 572 - RNA, 22 nt, Artificial Sequence
  Synthetic
gcggggagucacaugggaguca

SEQ ID NO: 573 - RNA, 20 nt, Artificial Sequence
  Synthetic
ggggagucacaugggaguca

SEQ ID NO: 574 - RNA, 19 nt, Artificial Sequence
  Synthetic
gggagucacaugggaguca

SEQ ID NO: 575 - RNA, 18 nt, Artificial Sequence
  Synthetic
ggagucacaugggaguca

SEQ ID NO: 576 - RNA, 22 nt, Artificial Sequence
  Synthetic
gcuuuugacaguuuuuaaggcg

SEQ ID NO: 577 - RNA, 21 nt, Artificial Sequence
  Synthetic
gaucauucuuguggcaguaag

SEQ ID NO: 578 - RNA, 18 nt, Artificial Sequence
  Synthetic
gagcaagagaugaacuag

SEQ ID NO: 579 - RNA, 23 nt, Artificial Sequence
  Synthetic
guagauugagguagaaucaagaa

SEQ ID NO: 580 - RNA, 20 nt, Artificial Sequence
  Synthetic
gauugagguagaaucaagaa

SEQ ID NO: 581 - RNA, 24 nt, Artificial Sequence
  Synthetic
ggauguaagacuggagauagagac

SEQ ID NO: 582 - RNA, 23 nt, Artificial Sequence
  Synthetic
gauguaagacuggagauagagac

SEQ ID NO: 583 - RNA, 24 nt, Artificial Sequence
  Synthetic
gggagucacaugggagucacaggg

SEQ ID NO: 584 - RNA, 23 nt, Artificial Sequence
  Synthetic
ggagucacaugggagucacaggg

SEQ ID NO: 585 - RNA, 22 nt, Artificial Sequence
  Synthetic
gagucacaugggagucacaggg

SEQ ID NO: 586 - RNA, 20 nt, Artificial Sequence
  Synthetic
gucacaugggagucacaggg

SEQ ID NO: 587 - RNA, 23 nt, Artificial Sequence
  Synthetic
guuuacauaucugucuuccuuaa

SEQ ID NO: 588 - RNA, 18 nt, Artificial Sequence
  Synthetic
gauuucaugugugaagaa

SEQ ID NO: 589 - RNA, 20 nt, Artificial Sequence
  Synthetic
gaguucaagcuaauacauga

SEQ ID NO: 590 - RNA, 17 nt, Artificial Sequence
  Synthetic
guuguucugaguagcuu

SEQ ID NO: 591 - RNA, 20 nt, Artificial Sequence
  Synthetic
ggcaaaagcagcagaaagca

SEQ ID NO: 592 - RNA, 17 nt, Artificial Sequence
  Synthetic
guggcugaaugacuucu

SEQ ID NO: 593 - RNA, 17 nt, Artificial Sequence
  Synthetic
gacuagaggucacgaaa

SEQ ID NO: 594 - RNA, 17 nt, Artificial Sequence
  Synthetic
cucauaccuaucccuau

SEQ ID NO: 595 - RNA, 17 nt, Artificial Sequence
  Synthetic
acacugccaauagggau

SEQ ID NO: 596 - RNA, 17 nt, Artificial Sequence
  Synthetic
caauuacaacuggggcc

SEQ ID NO: 597 - RNA, 17 nt, Artificial Sequence
  Synthetic
cuaagacacugccaaua

SEQ ID NO: 598 - RNA, 17 nt, Artificial Sequence
  Synthetic
auacucacaauuacaac

SEQ ID NO: 599 - RNA, 20 nt, Artificial Sequence
  Synthetic
uaucucauaccuaucccuau

SEQ ID NO: 600 - RNA, 20 nt, Artificial Sequence
  Synthetic
aagacacugccaauagggau

SEQ ID NO: 601 - RNA, 20 nt, Artificial Sequence
  Synthetic
ucacaauuacaacuggggcc

SEQ ID NO: 602 - RNA, 20 nt, Artificial Sequence
  Synthetic
agauacucacaauuacaacu

SEQ ID NO: 603 - RNA, 17 nt, Artificial Sequence
  Synthetic
acuaagacacugccaau

SEQ ID NO: 604 - RNA, 17 nt, Artificial Sequence
  Synthetic
uacucacaauuacaacu

SEQ ID NO: 605 - RNA, 17 nt, Artificial Sequence
  Synthetic
acucacaauuacaacug

SEQ ID NO: 606 - RNA, 17 nt, Artificial Sequence
  Synthetic
acaacuggggccaggug

SEQ ID NO: 607 - RNA, 17 nt, Artificial Sequence
  Synthetic
acuggggccaggugcgg

SEQ ID NO: 608 - RNA, 17 nt, Artificial Sequence
  Synthetic
augugagccaccgcacc

SEQ ID NO: 609 - RNA, 20 nt, Artificial Sequence
  Synthetic
aaacuaagacacugccaaua

SEQ ID NO: 610 - RNA, 20 nt, Artificial Sequence
  Synthetic
aaaacuaagacacugccaau

SEQ ID NO: 611 - RNA, 20 nt, Artificial Sequence
  Synthetic
auuacaacuggggccaggug

SEQ ID NO: 612 - RNA, 20 nt, Artificial Sequence
  Synthetic
acaacuggggccaggugcgg

SEQ ID NO: 613 - RNA, 20 nt, Artificial Sequence
  Synthetic
cacugccaauagggauaggu

SEQ ID NO: 614 - RNA, 17 nt, Artificial Sequence
  Synthetic
ugccaauagggauaggu

SEQ ID NO: 615 - RNA, 20 nt, Artificial Sequence
  Synthetic
ugagauacucacaauuacaa

SEQ ID NO: 616 - RNA, 20 nt, Artificial Sequence
  Synthetic
accuggccccaguuguaauu

SEQ ID NO: 617 - RNA, 17 nt, Artificial Sequence
  Synthetic
uggccccaguuguaauu

SEQ ID NO: 618 - RNA, 17 nt, Artificial Sequence
  Synthetic
agcuaccgguuaccuga

SEQ ID NO: 619 - RNA, 20 nt, Artificial Sequence
  Synthetic
uuuaaggcggggagucacau

SEQ ID NO: 620 - RNA, 20 nt, Artificial Sequence
  Synthetic
aaagcuaccgguuaccugaa

SEQ ID NO: 621 - RNA, 20 nt, Artificial Sequence
  Synthetic
aaaagcuaccgguuaccuga

SEQ ID NO: 622 - RNA, 20 nt, Artificial Sequence
  Synthetic
acgugcucuuuucuauauau

SEQ ID NO: 623 - RNA, 20 nt, Artificial Sequence
  Synthetic
auuugacaccacaugcacug

SEQ ID NO: 624 - RNA, 20 nt, Artificial Sequence
  Synthetic
cgugcucuuuucuauauaua

SEQ ID NO: 625 - RNA, 20 nt, Artificial Sequence
  Synthetic
uggugucaaauauggugcuu

SEQ ID NO: 626 - RNA, 20 nt, Artificial Sequence
  Synthetic
acuuuuacccuucagguaac

SEQ ID NO: 627 - RNA, 20 nt, Artificial Sequence
  Synthetic
agugcauguggugucaaaua

SEQ ID NO: 628 - RNA, 20 nt, Artificial Sequence
  Synthetic
uacaugagagugauuagugg

SEQ ID NO: 629 - RNA, 20 nt, Artificial Sequence
  Synthetic
cguuguucugaguagcuuuc

SEQ ID NO: 630 - RNA, 20 nt, Artificial Sequence
  Synthetic
ccacaagaugucucuugccu

SEQ ID NO: 631 - RNA, 20 nt, Artificial Sequence
  Synthetic
ccuaggcaagagacaucuug

SEQ ID NO: 632 - RNA, 20 nt, Artificial Sequence
  Synthetic
ugccuaggacuuucuaaugc

SEQ ID NO: 633 - RNA, 20 nt, Artificial Sequence
  Synthetic
auuagcucaaaagcuuuugc

SEQ ID NO: 634 - RNA, 17 nt, Artificial Sequence
  Synthetic
gcuuuugacaguuuuua

SEQ ID NO: 635 - RNA, 20 nt, Artificial Sequence
  Synthetic
ggagauagagacaggaauaa

SEQ ID NO: 636 - RNA, 17 nt, Artificial Sequence
  Synthetic
aaggcggggagucacau

SEQ ID NO: 637 - RNA, 17 nt, Artificial Sequence
  Synthetic
uaaggcggggagucaca

SEQ ID NO: 638 - RNA, 17 nt, Artificial Sequence
  Synthetic
ugaacucugugccaaac

SEQ ID NO: 639 - RNA, 17 nt, Artificial Sequence
  Synthetic
uuuacccuucagguaac

SEQ ID NO: 640 - RNA, 17 nt, Artificial Sequence
  Synthetic
ugacaccacaugcacug

SEQ ID NO: 641 - RNA, 17 nt, Artificial Sequence
  Synthetic
uugcucuagaugacaug

SEQ ID NO: 642 - RNA, 17 nt, Artificial Sequence
  Synthetic
ugacaguuuuuaaggcg

SEQ ID NO: 643 - RNA, 17 nt, Artificial Sequence
  Synthetic
ugucaaauauggugcuu

SEQ ID NO: 644 - RNA, 17 nt, Artificial Sequence
  Synthetic
agucacaugggagucac

SEQ ID NO: 645 - RNA, 17 nt, Artificial Sequence
  Synthetic
augagagugauuagugg

SEQ ID NO: 646 - RNA, 17 nt, Artificial Sequence
  Synthetic
ugacaugagguaaguag

SEQ ID NO: 647 - RNA, 17 nt, Artificial Sequence
  Synthetic
uacaugagagugauuag

SEQ ID NO: 648 - RNA, 17 nt, Artificial Sequence
  Synthetic
uaaggaggauguaagac

SEQ ID NO: 649 - RNA, 17 nt, Artificial Sequence
  Synthetic
cuugacuuuuacccuuc

SEQ ID NO: 650 - RNA, 17 nt, Artificial Sequence
  Synthetic
ucacugagcaaaacaac

SEQ ID NO: 651 - RNA, 17 nt, Artificial Sequence
  Synthetic
agacuuauauuccauua

SEQ ID NO: 652 - RNA, 17 nt, Artificial Sequence
  Synthetic
caugggagucacagggu

SEQ ID NO: 653 - RNA, 17 nt, Artificial Sequence
  Synthetic
uagaaugaucauucuug

SEQ ID NO: 654 - RNA, 17 nt, Artificial Sequence
  Synthetic
uugacaguuuuuaaggc

SEQ ID NO: 655 - RNA, 17 nt, Artificial Sequence
  Synthetic
aaacugucaaaagcuac

SEQ ID NO: 656 - RNA, 17 nt, Artificial Sequence
  Synthetic
augacaugagguaagua

SEQ ID NO: 657 - RNA, 17 nt, Artificial Sequence
  Synthetic
uguuucaaaacuuguuc

SEQ ID NO: 658 - RNA, 17 nt, Artificial Sequence
  Synthetic
auaucugucuuccuuaa

SEQ ID NO: 659 - RNA, 17 nt, Artificial Sequence
  Synthetic
ugaacaaguuuugaaac

SEQ ID NO: 660 - RNA, 17 nt, Artificial Sequence
  Synthetic
uucugcaucuuauacau

SEQ ID NO: 661 - RNA, 17 nt, Artificial Sequence
  Synthetic
auaagucuuuugauaua

SEQ ID NO: 662 - RNA, 17 nt, Artificial Sequence
  Synthetic
uuugacaguuuuuaagg

SEQ ID NO: 663 - RNA, 17 nt, Artificial Sequence
  Synthetic
ugcucuuuucuauauau

SEQ ID NO: 664 - RNA, 17 nt, Artificial Sequence
  Synthetic
agacuggagauagagac

SEQ ID NO: 665 - RNA, 17 nt, Artificial Sequence
  Synthetic
cauaagaaagaacacug

SEQ ID NO: 666 - RNA, 17 nt, Artificial Sequence
  Synthetic
uucuuguggcaguaagg

SEQ ID NO: 667 - RNA, 17 nt, Artificial Sequence
  Synthetic
aagcauacuuuuuuuaa

SEQ ID NO: 668 - RNA, 17 nt, Artificial Sequence
  Synthetic
caacuggaagagagaaa

SEQ ID NO: 669 - RNA, 17 nt, Artificial Sequence
  Synthetic
uaugcuuaagaaaaaaa

SEQ ID NO: 670 - RNA, 17 nt, Artificial Sequence
  Synthetic
uuuuauuaucuuuauug

SEQ ID NO: 671 - RNA, 20 nt, Artificial Sequence
  Synthetic
cuagaugacaugagguaagu

SEQ ID NO: 672 - RNA, 20 nt, Artificial Sequence
  Synthetic
uuuuaaggcggggagucaca

SEQ ID NO: 673 - RNA, 20 nt, Artificial Sequence
  Synthetic
uccuguuucaaaacuuguuc

SEQ ID NO: 674 - RNA, 20 nt, Artificial Sequence
  Synthetic
uguguugaguaucuccuguu

SEQ ID NO: 675 - RNA, 20 nt, Artificial Sequence
  Synthetic
cucuugcucuagaugacaug

SEQ ID NO: 676 - RNA, 20 nt, Artificial Sequence
  Synthetic
caguaaggaggauguaagac

SEQ ID NO: 677 - RNA, 20 nt, Artificial Sequence
  Synthetic
agaugacaugagguaaguag

SEQ ID NO: 678 - RNA, 20 nt, Artificial Sequence
  Synthetic
aauucacugagcaaaacaac

SEQ ID NO: 679 - RNA, 20 nt, Artificial Sequence
  Synthetic
ucacaugggagucacagggu

SEQ ID NO: 680 - RNA, 20 nt, Artificial Sequence
  Synthetic
uagaugacaugagguaagua

SEQ ID NO: 681 - RNA, 20 nt, Artificial Sequence
  Synthetic
uuuugacaguuuuuaaggcg

SEQ ID NO: 682 - RNA, 20 nt, Artificial Sequence
  Synthetic
uaauacaugagagugauuag

SEQ ID NO: 683 - RNA, 20 nt, Artificial Sequence
  Synthetic
uaguucugcaucuuauacau

SEQ ID NO: 684 - RNA, 20 nt, Artificial Sequence
  Synthetic
cuuuugacaguuuuuaaggc

SEQ ID NO: 685 - RNA, 20 nt, Artificial Sequence
  Synthetic
aaaagacuuauauuccauua

SEQ ID NO: 686 - RNA, 20 nt, Artificial Sequence
  Synthetic
auacauaagaaagaacacug

SEQ ID NO: 687 - RNA, 20 nt, Artificial Sequence
  Synthetic
aauauaagucuuuugauaua

SEQ ID NO: 688 - RNA, 20 nt, Artificial Sequence
  Synthetic
ugaucauucuuguggcagua

SEQ ID NO: 689 - RNA, 20 nt, Artificial Sequence
  Synthetic
uacauaucugucuuccuuaa

SEQ ID NO: 690 - RNA, 20 nt, Artificial Sequence
  Synthetic
cuuaagcauacuuuuuuuaa

SEQ ID NO: 691 - RNA, 20 nt, Artificial Sequence
  Synthetic
aaacaacuggaagagagaaa

SEQ ID NO: 692 - RNA, 20 nt, Artificial Sequence
  Synthetic
ucauucuuguggcaguaagg

SEQ ID NO: 693 - RNA, 20 nt, Artificial Sequence
  Synthetic
aaguaugcuuaagaaaaaaa

SEQ ID NO: 694 - RNA, 20 nt, Artificial Sequence
  Synthetic
auuuuuuauuaucuuuauug

SEQ ID NO: 695 - RNA, 17 nt, Artificial Sequence
  Synthetic
cuaggacuuucuaaugc

SEQ ID NO: 696 - RNA, 17 nt, Artificial Sequence
  Synthetic
aucuaagauccuuucac

SEQ ID NO: 697 - RNA, 17 nt, Artificial Sequence
  Synthetic
uuaucaccacacuaaau

SEQ ID NO: 698 - RNA, 17 nt, Artificial Sequence
  Synthetic
agcucaaaagcuuuugc

SEQ ID NO: 699 - RNA, 17 nt, Artificial Sequence
  Synthetic
uguucugaguagcuuuc

SEQ ID NO: 700 - RNA, 17 nt, Artificial Sequence
  Synthetic
acuuucuaaugcuggag

SEQ ID NO: 701 - RNA, 17 nt, Artificial Sequence
  Synthetic
cucuauaccuuuuacug

SEQ ID NO: 702 - RNA, 17 nt, Artificial Sequence
  Synthetic
caagaugucucuugccu

SEQ ID NO: 703 - RNA, 17 nt, Artificial Sequence
  Synthetic
auuaugccuauuuagug

SEQ ID NO: 704 - RNA, 17 nt, Artificial Sequence
  Synthetic
augacucauaauuuagu

SEQ ID NO: 705 - RNA, 17 nt, Artificial Sequence
  Synthetic
uagaggcuuauggauuu

SEQ ID NO: 706 - RNA, 17 nt, Artificial Sequence
  Synthetic
uauucuacuccugugaa

SEQ ID NO: 707 - RNA, 17 nt, Artificial Sequence
  Synthetic
cuaaugcuggagaggau

SEQ ID NO: 708 - RNA, 17 nt, Artificial Sequence
  Synthetic
aggcaagagacaucuug

SEQ ID NO: 709 - RNA, 17 nt, Artificial Sequence
  Synthetic
agccucuauuucugaug

SEQ ID NO: 710 - RNA, 17 nt, Artificial Sequence
  Synthetic
cagcauuagaaaguccu

SEQ ID NO: 711 - RNA, 17 nt, Artificial Sequence
  Synthetic
cugcuuuugccaaagag

SEQ ID NO: 712 - RNA, 17 nt, Artificial Sequence
  Synthetic
acauaaucaccucucuu

SEQ ID NO: 713 - RNA, 17 nt, Artificial Sequence
  Synthetic
ucagaaauagaggcuua

SEQ ID NO: 714 - RNA, 17 nt, Artificial Sequence
  Synthetic
uuccucaucagaaauag

SEQ ID NO: 715 - RNA, 17 nt, Artificial Sequence
  Synthetic
acagaggacauggagaa

SEQ ID NO: 716 - RNA, 17 nt, Artificial Sequence
  Synthetic
uggagaggauaggacag

SEQ ID NO: 717 - RNA, 17 nt, Artificial Sequence
  Synthetic
aggaagaugaacaaauc

SEQ ID NO: 718 - RNA, 17 nt, Artificial Sequence
  Synthetic
agaugaaaaauacucuu

SEQ ID NO: 719 - RNA, 20 nt, Artificial Sequence
  Synthetic
aggacuuucuaaugcuggag

SEQ ID NO: 720 - RNA, 20 nt, Artificial Sequence
  Synthetic
cuccagcauuagaaaguccu

SEQ ID NO: 721 - RNA, 20 nt, Artificial Sequence
  Synthetic
aacaugacucauaauuuagu

SEQ ID NO: 722 - RNA, 20 nt, Artificial Sequence
  Synthetic
aucuuccucaucagaaauag

SEQ ID NO: 723 - RNA, 20 nt, Artificial Sequence
  Synthetic
auaagccucuauuucugaug

SEQ ID NO: 724 - RNA, 20 nt, Artificial Sequence
  Synthetic
ucuuauucuacuccugugaa

SEQ ID NO: 725 - RNA, 20 nt, Artificial Sequence
  Synthetic
cugcugcuuuugccaaagag

SEQ ID NO: 726 - RNA, 20 nt, Artificial Sequence
  Synthetic
uuucuaaugcuggagaggau

SEQ ID NO: 727 - RNA, 20 nt, Artificial Sequence
  Synthetic
aaauuaucaccacacuaaau

SEQ ID NO: 728 - RNA, 20 nt, Artificial Sequence
  Synthetic
cuuguucuguccucaguaaa

SEQ ID NO: 729 - RNA, 20 nt, Artificial Sequence
  Synthetic
aaaauuaugccuauuuagug

SEQ ID NO: 730 - RNA, 20 nt, Artificial Sequence
  Synthetic
ucaucagaaauagaggcuua

SEQ ID NO: 731 - RNA, 20 nt, Artificial Sequence
  Synthetic
aaauagaggcuuauggauuu

SEQ ID NO: 732 - RNA, 20 nt, Artificial Sequence
  Synthetic
ugcuggagaggauaggacag

SEQ ID NO: 733 - RNA, 20 nt, Artificial Sequence
  Synthetic
augaggaagaugaacaaauc

SEQ ID NO: 734 - RNA, 20 nt, Artificial Sequence
  Synthetic
cuuaucuaagauccuuucac

SEQ ID NO: 735 - RNA, 20 nt, Artificial Sequence
  Synthetic
agaggauaggacagaggaca

SEQ ID NO: 736 - RNA, 20 nt, Artificial Sequence
  Synthetic
aggacagaggacauggagaa

SEQ ID NO: 737 - RNA, 20 nt, Artificial Sequence
  Synthetic
aaagaugaaaaauacucuuu

SEQ ID NO: 738 - RNA, 17 nt, Artificial Sequence
  Synthetic
agcucaaaagcuuuugc

SEQ ID NO: 739 - RNA, 17 nt, Artificial Sequence
  Synthetic
uguucugaguagcuuuc

SEQ ID NO: 740 - RNA, 17 nt, Artificial Sequence
  Synthetic
augacucauaauuuagu

SEQ ID NO: 741 - RNA, 17 nt, Artificial Sequence
  Synthetic
uauucuacuccugugaa

SEQ ID NO: 742 - RNA, 17 nt, Artificial Sequence
  Synthetic
cugcuuuugccaaagag

SEQ ID NO: 743 - RNA, 17 nt, Artificial Sequence
  Synthetic
acauaaucaccucucuu

SEQ ID NO: 744 - RNA, 20 nt, Artificial Sequence
  Synthetic
aacaugacucauaauuuagu

SEQ ID NO: 745 - RNA, 20 nt, Artificial Sequence
  Synthetic
ucuuauucuacuccugugaa

SEQ ID NO: 746 - RNA, 20 nt, Artificial Sequence
  Synthetic
cugcugcuuuugccaaagag

SEQ ID NO: 747 - RNA, 20 nt, Artificial Sequence
  Synthetic
ccuacuuaccucaugucauc

SEQ ID NO: 748 - RNA, 20 nt, Artificial Sequence
  Synthetic
cuaugagccagcaaaagcuu

SEQ ID NO: 749 - RNA, 20 nt, Artificial Sequence
  Synthetic
acguuguucugaguagcuuu

SEQ ID NO: 750 - RNA, 20 nt, Artificial Sequence
  Synthetic
cauagagacacauucaguaa

SEQ ID NO: 751 - RNA, 17 nt, Artificial Sequence
  Synthetic
acuuaccucaugucauc

SEQ ID NO: 752 - RNA, 17 nt, Artificial Sequence
  Synthetic
ugagccagcaaaagcuu

SEQ ID NO: 753 - RNA, 17 nt, Artificial Sequence
  Synthetic
uuguucugaguagcuuu

SEQ ID NO: 754 - RNA, 17 nt, Artificial Sequence
  Synthetic
agagacacauucaguaa

SEQ ID NO: 755 - RNA, 20 nt, Artificial Sequence
  Synthetic
caaaagcuaccgguuaccug

SEQ ID NO: 756 - RNA, 20 nt, Artificial Sequence
  Synthetic
uuuuaaggcggggagucaca

SEQ ID NO: 757 - RNA, 20 nt, Artificial Sequence
  Synthetic
ugucaaaagcuaccgguuac

SEQ ID NO: 758 - RNA, 17 nt, Artificial Sequence
  Synthetic
aagcuaccgguuaccug

SEQ ID NO: 759 - RNA, 17 nt, Artificial Sequence
  Synthetic
caaaagcuaccgguuac

SEQ ID NO: 760 - RNA, 20 nt, Artificial Sequence
  Synthetic
uaggaauccugaaagcuacu

SEQ ID NO: 761 - RNA, 20 nt, Artificial Sequence
  Synthetic
cagaacaacguuuucauuua

SEQ ID NO: 762 - RNA, 20 nt, Artificial Sequence
  Synthetic
caaaagcuuuugcuggcuca

SEQ ID NO: 763 - RNA, 20 nt, Artificial Sequence
  Synthetic
agcaaaagcuuuugagcuaa

SEQ ID NO: 764 - RNA, 20 nt, Artificial Sequence
  Synthetic
aucuuauucuacuccuguga

SEQ ID NO: 765 - RNA, 17 nt, Artificial Sequence
  Synthetic
aacaacguuuucauuua

SEQ ID NO: 766 - RNA, 17 nt, Artificial Sequence
  Synthetic
aagcuuuugcuggcuca

SEQ ID NO: 767 - RNA, 17 nt, Artificial Sequence
  Synthetic
aaaagcuuuugagcuaa

SEQ ID NO: 768 - RNA, 17 nt, Artificial Sequence
  Synthetic
uuauucuacuccuguga

SEQ ID NO: 769 - RNA, 20 nt, Artificial Sequence
  Synthetic
gaaacaggaauagaaauuca

SEQ ID NO: 770 - RNA, 20 nt, Artificial Sequence
  Synthetic
gaauauaagucuuuugauau

SEQ ID NO: 771 - RNA, 20 nt, Artificial Sequence
  Synthetic
gagaaaugguucccuauaua

SEQ ID NO: 772 - RNA, 20 nt, Artificial Sequence
  Synthetic
gagaggauaggacagaggac

SEQ ID NO: 773 - RNA, 20 nt, Artificial Sequence
  Synthetic
gaugaggaagaugaacaaau

SEQ ID NO: 774 - RNA, 20 nt, Artificial Sequence
  Synthetic
gauuuguucaucuuccucau

SEQ ID NO: 775 - RNA, 20 nt, Artificial Sequence
  Synthetic
gcaguaaggaggauguaaga

SEQ ID NO: 776 - RNA, 20 nt, Artificial Sequence
  Synthetic
gcuuucugcugcuuuugcca

SEQ ID NO: 777 - RNA, 20 nt, Artificial Sequence
  Synthetic
gcuuucugcugcuuuugcca

SEQ ID NO: 778 - RNA, 20 nt, Artificial Sequence
  Synthetic
ggaaagaugaaaaauacucu

SEQ ID NO: 779 - RNA, 20 nt, Artificial Sequence
  Synthetic
ggaggauguaagacuggaga

SEQ ID NO: 780 - RNA, 20 nt, Artificial Sequence
  Synthetic
ggugauuauguuacuuuuua

SEQ ID NO: 781 - RNA, 20 nt, Artificial Sequence
  Synthetic
ggugauuauguuacuuuuua

SEQ ID NO: 782 - RNA, 20 nt, Artificial Sequence
  Synthetic
guggugucaaauauggugcu

SEQ ID NO: 783 - RNA, 17 nt, Artificial Sequence
  Synthetic
gaaaaaaaagguaaugc

SEQ ID NO: 784 - RNA, 17 nt, Artificial Sequence
  Synthetic
gaaaagagcacguacaa

SEQ ID NO: 785 - RNA, 17 nt, Artificial Sequence
  Synthetic
gaaugaucauucuaaac

SEQ ID NO: 786 - RNA, 17 nt, Artificial Sequence
  Synthetic
gacagaggacauggaga

SEQ ID NO: 787 - RNA, 17 nt, Artificial Sequence
  Synthetic
gacuuucuaaugcugga

SEQ ID NO: 788 - RNA, 17 nt, Artificial Sequence
  Synthetic
gagagugauuaguggug

SEQ ID NO: 789 - RNA, 17 nt, Artificial Sequence
  Synthetic
gagcaaaacaacuggaa

SEQ ID NO: 790 - RNA, 17 nt, Artificial Sequence
  Synthetic
gaggaagaugaacaaau

SEQ ID NO: 791 - RNA, 17 nt, Artificial Sequence
  Synthetic
gagucacaugggaguca

SEQ ID NO: 792 - RNA, 17 nt, Artificial Sequence
  Synthetic
gaucuuauucuacuccu

SEQ ID NO: 793 - RNA, 17 nt, Artificial Sequence
  Synthetic
gauuauguuacuuuuua

SEQ ID NO: 794 - RNA, 17 nt, Artificial Sequence
  Synthetic
gcaaaacaacuggaaga

SEQ ID NO: 795 - RNA, 17 nt, Artificial Sequence
  Synthetic
ggauguaagacuggaga

SEQ ID NO: 796 - RNA, 17 nt, Artificial Sequence
  Synthetic
guaaggaggauguaaga

SEQ ID NO: 797 - RNA, 17 nt, Artificial Sequence
  Synthetic
guaucuccuguuuggca

SEQ ID NO: 798 - RNA, 17 nt, Artificial Sequence
  Synthetic
gucaucuagagcaagag

SEQ ID NO: 799 - RNA, 17 nt, Artificial Sequence
  Synthetic
guccucaguaaaaggua

SEQ ID NO: 800 - RNA, 17 nt, Artificial Sequence
  Synthetic
gugaaaggaucuuagau

SEQ ID NO: 801 - RNA, 17 nt, Artificial Sequence
  Synthetic
gugcucuuuucuauaua

SEQ ID NO: 802 - RNA, 17 nt, Artificial Sequence
  Synthetic
gugucaaauauggugcu

SEQ ID NO: 803 - RNA, 17 nt, Artificial Sequence
  Synthetic
guucccuauauauagaa

SEQ ID NO: 804 - RNA, 20 nt, Artificial Sequence
  Synthetic
aaaagacuuauauuccauua

SEQ ID NO: 805 - RNA, 20 nt, Artificial Sequence
  Synthetic
aaacaugacucauaauuuag

SEQ ID NO: 806 - RNA, 20 nt, Artificial Sequence
  Synthetic
aaacaugacucauaauuuag

SEQ ID NO: 807 - RNA, 20 nt, Artificial Sequence
  Synthetic
aaagaugaaaaauacucuuu

SEQ ID NO: 808 - RNA, 20 nt, Artificial Sequence
  Synthetic
aaauucacugagcaaaacaa

SEQ ID NO: 809 - RNA, 20 nt, Artificial Sequence
  Synthetic
aacaaguuuugaaacaggaa

SEQ ID NO: 810 - RNA, 20 nt, Artificial Sequence
  Synthetic
aacaggagauacucaacaca

SEQ ID NO: 811 - RNA, 20 nt, Artificial Sequence
  Synthetic
aacaugacucauaauuuagu

SEQ ID NO: 812 - RNA, 20 nt, Artificial Sequence
  Synthetic
aacaugacucauaauuuagu

SEQ ID NO: 813 - RNA, 20 nt, Artificial Sequence
  Synthetic
aauauaagucuuuugauaua

SEQ ID NO: 814 - RNA, 20 nt, Artificial Sequence
  Synthetic
aaucacucucauguauuagc

SEQ ID NO: 815 - RNA, 20 nt, Artificial Sequence
  Synthetic
aauucacugagcaaaacaac

SEQ ID NO: 816 - RNA, 20 nt, Artificial Sequence
  Synthetic
acaaaagaacauacauaaga

SEQ ID NO: 817 - RNA, 20 nt, Artificial Sequence
  Synthetic
acguacaaaagaacauacau

SEQ ID NO: 818 - RNA, 20 nt, Artificial Sequence
  Synthetic
acguuguucugaguagcuuu

SEQ ID NO: 819 - RNA, 20 nt, Artificial Sequence
  Synthetic
acugagcaaaacaacuggaa

SEQ ID NO: 820 - RNA, 20 nt, Artificial Sequence
  Synthetic
agaggauaggacagaggaca

SEQ ID NO: 821 - RNA, 20 nt, Artificial Sequence
  Synthetic
agaugcagaacuaguguaga

SEQ ID NO: 822 - RNA, 20 nt, Artificial Sequence
  Synthetic
agcaaaagcuuuugagcuaa

SEQ ID NO: 823 - RNA, 20 nt, Artificial Sequence
  Synthetic
agcauuagaaaguccuaggc

SEQ ID NO: 824 - RNA, 20 nt, Artificial Sequence
  Synthetic
agcuugaacucugugccaaa

SEQ ID NO: 825 - RNA, 20 nt, Artificial Sequence
  Synthetic
agcuuuugacaguuuuuaag

SEQ ID NO: 826 - RNA, 20 nt, Artificial Sequence
  Synthetic
aggacagaggacauggagaa

SEQ ID NO: 827 - RNA, 20 nt, Artificial Sequence
  Synthetic
aggauaggacagaggacaug

SEQ ID NO: 828 - RNA, 20 nt, Artificial Sequence
  Synthetic
agguaaugccugaacaaguu

SEQ ID NO: 829 - RNA, 20 nt, Artificial Sequence
  Synthetic
auaagaaagaacacuguggu

SEQ ID NO: 830 - RNA, 20 nt, Artificial Sequence
  Synthetic
auaagccucuauuucugaug

SEQ ID NO: 831 - RNA, 20 nt, Artificial Sequence
  Synthetic
auacaugagagugauuagug

SEQ ID NO: 832 - RNA, 20 nt, Artificial Sequence
  Synthetic
auagaaaagagcacguacaa

SEQ ID NO: 833 - RNA, 20 nt, Artificial Sequence
  Synthetic
aucauucuuguggcaguaag

SEQ ID NO: 834 - RNA, 20 nt, Artificial Sequence
  Synthetic
aucuuauucuacuccuguga

SEQ ID NO: 835 - RNA, 20 nt, Artificial Sequence
  Synthetic
aucuuguggauaauguauca

SEQ ID NO: 836 - RNA, 20 nt, Artificial Sequence
  Synthetic
augaggaagaugaacaaauc

SEQ ID NO: 837 - RNA, 20 nt, Artificial Sequence
  Synthetic
augaucauucuuguggcagu

SEQ ID NO: 838 - RNA, 20 nt, Artificial Sequence
  Synthetic
augcuggagaggauaggaca

SEQ ID NO: 839 - RNA, 20 nt, Artificial Sequence
  Synthetic
augguucccuauauauagaa

SEQ ID NO: 840 - RNA, 20 nt, Artificial Sequence
  Synthetic
auuuaauuuguuucugugug

SEQ ID NO: 841 - RNA, 20 nt, Artificial Sequence
  Synthetic
caaaaccuauguauaagaug

SEQ ID NO: 842 - RNA, 20 nt, Artificial Sequence
  Synthetic
caaaagacuuauauuccauu

SEQ ID NO: 843 - RNA, 20 nt, Artificial Sequence
  Synthetic
caaaagcuuuugcuggcuca

SEQ ID NO: 844 - RNA, 20 nt, Artificial Sequence
  Synthetic
caagaaugaucauucuaaac

SEQ ID NO: 845 - RNA, 20 nt, Artificial Sequence
  Synthetic
cacagaguucaagcuaauac

SEQ ID NO: 846 - RNA, 20 nt, Artificial Sequence
  Synthetic
cacaggguaggauucauguu

SEQ ID NO: 847 - RNA, 20 nt, Artificial Sequence
  Synthetic
cagaacaacguuuucauuua

SEQ ID NO: 848 - RNA, 20 nt, Artificial Sequence
  Synthetic
cagaguucaagcuaauacau

SEQ ID NO: 849 - RNA, 20 nt, Artificial Sequence
  Synthetic
caguaaaugaaaacguuguu

SEQ ID NO: 850 - RNA, 20 nt, Artificial Sequence
  Synthetic
caguaaggaggauguaagac

SEQ ID NO: 851 - RNA, 20 nt, Artificial Sequence
  Synthetic
cauaagccucuauuucugau

SEQ ID NO: 852 - RNA, 20 nt, Artificial Sequence
  Synthetic
cauagagacacauucaguaa

SEQ ID NO: 853 - RNA, 20 nt, Artificial Sequence
  Synthetic
caucucuugcucuagaugac

SEQ ID NO: 854 - RNA, 20 nt, Artificial Sequence
  Synthetic
caugagagugauuaguggug

SEQ ID NO: 855 - RNA, 20 nt, Artificial Sequence
  Synthetic
caugucaucuagagcaagag

SEQ ID NO: 856 - RNA, 20 nt, Artificial Sequence
  Synthetic
cauuuacugaaugugucucu

SEQ ID NO: 857 - RNA, 20 nt, Artificial Sequence
  Synthetic
ccauuaaaaaaaguaugcuu

SEQ ID NO: 858 - RNA, 20 nt, Artificial Sequence
  Synthetic
ccuaggacuuucuaaugcug

SEQ ID NO: 859 - RNA, 20 nt, Artificial Sequence
  Synthetic
ccucucuuuggcaaaagcag

SEQ ID NO: 860 - RNA, 20 nt, Artificial Sequence
  Synthetic
ccugugaaaggaucuuagau

SEQ ID NO: 861 - RNA, 20 nt, Artificial Sequence
  Synthetic
cuaagauccuuucacaggag

SEQ ID NO: 862 - RNA, 20 nt, Artificial Sequence
  Synthetic
cuagaugacaugagguaagu

SEQ ID NO: 863 - RNA, 20 nt, Artificial Sequence
  Synthetic
cuaugagccagcaaaagcuu

SEQ ID NO: 864 - RNA, 20 nt, Artificial Sequence
  Synthetic
cucauaauuuaguaggaauc

SEQ ID NO: 865 - RNA, 20 nt, Artificial Sequence
  Synthetic
cucaucagaaauagaggcuu

SEQ ID NO: 866 - RNA, 20 nt, Artificial Sequence
  Synthetic
cucuauuucugaugaggaag

SEQ ID NO: 867 - RNA, 20 nt, Artificial Sequence
  Synthetic
cuuaagcauacuuuuuuuaa

SEQ ID NO: 868 - RNA, 20 nt, Artificial Sequence
  Synthetic
cuuaucuaagauccuuucac

SEQ ID NO: 869 - RNA, 20 nt, Artificial Sequence
  Synthetic
cuuucuaaugcuggagagga

SEQ ID NO: 870 - RNA, 20 nt, Artificial Sequence
  Synthetic
cuuuugacaguuuuuaaggc

SEQ ID NO: 871 - RNA, 20 nt, Artificial Sequence
  Synthetic
uaaaacuaagacacugccaa

SEQ ID NO: 872 - RNA, 20 nt, Artificial Sequence
  Synthetic
uaagaaaaaaaagguaaugc

SEQ ID NO: 873 - RNA, 20 nt, Artificial Sequence
  Synthetic
uaaugcuggagaggauagga

SEQ ID NO: 874 - RNA, 20 nt, Artificial Sequence
  Synthetic
uacauaucugucuuccuuaa

SEQ ID NO: 875 - RNA, 20 nt, Artificial Sequence
  Synthetic
uacauccuccuuacugccac

SEQ ID NO: 876 - RNA, 20 nt, Artificial Sequence
  Synthetic
uaccucaugucaucuagagc

SEQ ID NO: 877 - RNA, 20 nt, Artificial Sequence
  Synthetic
uacgugcucuuuucuauaua

SEQ ID NO: 878 - RNA, 20 nt, Artificial Sequence
  Synthetic
uagagcaagagaugaacuag

SEQ ID NO: 879 - RNA, 20 nt, Artificial Sequence
  Synthetic
uagaugacaugagguaagua

SEQ ID NO: 880 - RNA, 20 nt, Artificial Sequence
  Synthetic
uaggaauccugaaagcuacu

SEQ ID NO: 881 - RNA, 20 nt, Artificial Sequence
  Synthetic
uaggacagaggacauggaga

SEQ ID NO: 882 - RNA, 20 nt, Artificial Sequence
  Synthetic
uaggacuuucuaaugcugga

SEQ ID NO: 883 - RNA, 20 nt, Artificial Sequence
  Synthetic
ucacugagcaaaacaacugg

SEQ ID NO: 884 - RNA, 20 nt, Artificial Sequence
  Synthetic
ucauguuuaucaauauuauu

SEQ ID NO: 885 - RNA, 20 nt, Artificial Sequence
  Synthetic
uccacaagaugucucuugcc

SEQ ID NO: 886 - RNA, 20 nt, Artificial Sequence
  Synthetic
uccauaagccucuauuucug

SEQ ID NO: 887 - RNA, 20 nt, Artificial Sequence
  Synthetic
uccuaggcaagagacaucuu

SEQ ID NO: 888 - RNA, 20 nt, Artificial Sequence
  Synthetic
ucuagaugacaugagguaag

SEQ ID NO: 889 - RNA, 20 nt, Artificial Sequence
  Synthetic
ucuauaccuuuuacugagga

SEQ ID NO: 890 - RNA, 20 nt, Artificial Sequence
  Synthetic
ucuguccucaguaaaaggua

SEQ ID NO: 891 - RNA, 20 nt, Artificial Sequence
  Synthetic
ucuuaagcauacuuuuuuua

SEQ ID NO: 892 - RNA, 20 nt, Artificial Sequence
  Synthetic
ucuuaucuaagauccuuuca

SEQ ID NO: 893 - RNA, 20 nt, Artificial Sequence
  Synthetic
ucuuccaguuguuuugcuca

SEQ ID NO: 894 - RNA, 20 nt, Artificial Sequence
  Synthetic
ugagcaaaacaacuggaaga

SEQ ID NO: 895 - RNA, 20 nt, Artificial Sequence
  Synthetic
ugaguaucuccuguuuggca

SEQ ID NO: 896 - RNA, 20 nt, Artificial Sequence
  Synthetic
ugaucauucuuguggcagua

SEQ ID NO: 897 - RNA, 20 nt, Artificial Sequence
  Synthetic
ugccugaacaaguuuugaaa

SEQ ID NO: 898 - RNA, 20 nt, Artificial Sequence
  Synthetic
uguaagacuggagauagaga

SEQ ID NO: 899 - RNA, 20 nt, Artificial Sequence
  Synthetic
uguccuauccucuccagcau

SEQ ID NO: 900 - RNA, 20 nt, Artificial Sequence
  Synthetic
uuaacguuaucauuuuccca

SEQ ID NO: 901 - RNA, 20 nt, Artificial Sequence
  Synthetic
uuacauaucugucuuccuua

SEQ ID NO: 902 - RNA, 20 nt, Artificial Sequence
  Synthetic
uuagaucuuauucuacuccu

SEQ ID NO: 903 - RNA, 20 nt, Artificial Sequence
  Synthetic
uuagaucuuauucuacuccu

SEQ ID NO: 904 - RNA, 20 nt, Artificial Sequence
  Synthetic
uucaggauuccuacuaaauu

SEQ ID NO: 905 - RNA, 20 nt, Artificial Sequence
  Synthetic
uucaucuuccucaucagaaa

SEQ ID NO: 906 - RNA, 20 nt, Artificial Sequence
  Synthetic
uugccuaggacuuucuaaug

SEQ ID NO: 907 - RNA, 20 nt, Artificial Sequence
  Synthetic
uuucugcugcuuuugccaaa

SEQ ID NO: 908 - RNA, 20 nt, Artificial Sequence
  Synthetic
uuuugacaguuuuuaaggcg

SEQ ID NO: 909 - RNA, 20 nt, Artificial Sequence
  Synthetic
uuuuuaaggcggggagucac

SEQ ID NO: 910 - RNA, 17 nt, Artificial Sequence
  Synthetic
aaaagcuuuugagcuaa

SEQ ID NO: 911 - RNA, 17 nt, Artificial Sequence
  Synthetic
aaagaacauacauaaga

SEQ ID NO: 912 - RNA, 17 nt, Artificial Sequence
  Synthetic
aaaugguucccuauaua

SEQ ID NO: 913 - RNA, 17 nt, Artificial Sequence
  Synthetic
aacaacguuuucauuua

SEQ ID NO: 914 - RNA, 17 nt, Artificial Sequence
  Synthetic
aaccuauguauaagaug

SEQ ID NO: 915 - RNA, 17 nt, Artificial Sequence
  Synthetic
aacuaagacacugccaa

SEQ ID NO: 916 - RNA, 17 nt, Artificial Sequence
  Synthetic
aagacuggagauagaga

SEQ ID NO: 917 - RNA, 17 nt, Artificial Sequence
  Synthetic
aagacuuauauuccauu

SEQ ID NO: 918 - RNA, 17 nt, Artificial Sequence
  Synthetic
aagaugaaaaauacucu

SEQ ID NO: 919 - RNA, 17 nt, Artificial Sequence
  Synthetic
aagcauacuuuuuuuaa

SEQ ID NO: 920 - RNA, 17 nt, Artificial Sequence
  Synthetic
aagccucuauuucugau

SEQ ID NO: 921 - RNA, 17 nt, Artificial Sequence
  Synthetic
aagcuuuugcuggcuca

SEQ ID NO: 922 - RNA, 17 nt, Artificial Sequence
  Synthetic
aaguuuugaaacaggaa

SEQ ID NO: 923 - RNA, 17 nt, Artificial Sequence
  Synthetic
acaagaugucucuugcc

SEQ ID NO: 924 - RNA, 17 nt, Artificial Sequence
  Synthetic
acagaggacauggagaa

SEQ ID NO: 925 - RNA, 17 nt, Artificial Sequence
  Synthetic
acaggaauagaaauuca

SEQ ID NO: 926 - RNA, 17 nt, Artificial Sequence
  Synthetic
acaugggagucacaggg

SEQ ID NO: 927 - RNA, 17 nt, Artificial Sequence
  Synthetic
acguuaucauuuuccca

SEQ ID NO: 928 - RNA, 17 nt, Artificial Sequence
  Synthetic
agaaagaacacuguggu

SEQ ID NO: 929 - RNA, 17 nt, Artificial Sequence
  Synthetic
agacuggagauagagac

SEQ ID NO: 930 - RNA, 17 nt, Artificial Sequence
  Synthetic
agagacacauucaguaa

SEQ ID NO: 931 - RNA, 17 nt, Artificial Sequence
  Synthetic
agaguucaagcuaauac

SEQ ID NO: 932 - RNA, 17 nt, Artificial Sequence
  Synthetic
agauccuuucacaggag

SEQ ID NO: 933 - RNA, 17 nt, Artificial Sequence
  Synthetic
agaugaaaaauacucuu

SEQ ID NO: 934 - RNA, 17 nt, Artificial Sequence
  Synthetic
agaugacaugagguaag

SEQ ID NO: 935 - RNA, 17 nt, Artificial Sequence
  Synthetic
agcaagagaugaacuag

SEQ ID NO: 936 - RNA, 17 nt, Artificial Sequence
  Synthetic
agccucuauuucugaug

SEQ ID NO: 937 - RNA, 17 nt, Artificial Sequence
  Synthetic
aggaagaugaacaaauc

SEQ ID NO: 938 - RNA, 17 nt, Artificial Sequence
  Synthetic
aggacuuucuaaugcug

SEQ ID NO: 939 - RNA, 17 nt, Artificial Sequence
  Synthetic
aggagauacucaacaca

SEQ ID NO: 940 - RNA, 17 nt, Artificial Sequence
  Synthetic
aggauaggacagaggac

SEQ ID NO: 941 - RNA, 17 nt, Artificial Sequence
  Synthetic
aggauuccuacuaaauu

SEQ ID NO: 942 - RNA, 17 nt, Artificial Sequence
  Synthetic
aggguaggauucauguu

SEQ ID NO: 943 - RNA, 17 nt, Artificial Sequence
  Synthetic
aguucaagcuaauacau

SEQ ID NO: 944 - RNA, 17 nt, Artificial Sequence
  Synthetic
auaagccucuauuucug

SEQ ID NO: 945 - RNA, 17 nt, Artificial Sequence
  Synthetic
auaagucuuuugauaua

SEQ ID NO: 946 - RNA, 17 nt, Artificial Sequence
  Synthetic
auaauuuaguaggaauc

SEQ ID NO: 947 - RNA, 17 nt, Artificial Sequence
  Synthetic
auaccuuuuacugagga

SEQ ID NO: 948 - RNA, 17 nt, Artificial Sequence
  Synthetic
auagaggcuuauggauu

SEQ ID NO: 949 - RNA, 17 nt, Artificial Sequence
  Synthetic
auaggacagaggacaug

SEQ ID NO: 950 - RNA, 17 nt, Artificial Sequence
  Synthetic
auaucugucuuccuuaa

SEQ ID NO: 951 - RNA, 17 nt, Artificial Sequence
  Synthetic
aucagaaauagaggcuu

SEQ ID NO: 952 - RNA, 17 nt, Artificial Sequence
  Synthetic
aucauucuuguggcagu

SEQ ID NO: 953 - RNA, 17 nt, Artificial Sequence
  Synthetic
auccuccuuacugccac

SEQ ID NO: 954 - RNA, 17 nt, Artificial Sequence
  Synthetic
aucuaagauccuuucac

SEQ ID NO: 955 - RNA, 17 nt, Artificial Sequence
  Synthetic
aucuuccucaucagaaa

SEQ ID NO: 956 - RNA, 17 nt, Artificial Sequence
  Synthetic
augacucauaauuuagu

SEQ ID NO: 957 - RNA, 17 nt, Artificial Sequence
  Synthetic
auuagaaaguccuaggc

SEQ ID NO: 958 - RNA, 17 nt, Artificial Sequence
  Synthetic
auucuuguggcaguaag

SEQ ID NO: 959 - RNA, 17 nt, Artificial Sequence
  Synthetic
cacucucauguauuagc

SEQ ID NO: 960 - RNA, 17 nt, Artificial Sequence
  Synthetic
cauaucugucuuccuua

SEQ ID NO: 961 - RNA, 17 nt, Artificial Sequence
  Synthetic
caugacucauaauuuag

SEQ ID NO: 962 - RNA, 17 nt, Artificial Sequence
  Synthetic
caugagagugauuagug

SEQ ID NO: 963 - RNA, 17 nt, Artificial Sequence
  Synthetic
ccuaggacuuucuaaug

SEQ ID NO: 964 - RNA, 17 nt, Artificial Sequence
  Synthetic
ccuauccucuccagcau

SEQ ID NO: 965 - RNA, 17 nt, Artificial Sequence
  Synthetic
cuaggacuuucuaaugc

SEQ ID NO: 966 - RNA, 17 nt, Artificial Sequence
  Synthetic
cucaugucaucuagagc

SEQ ID NO: 967 - RNA, 17 nt, Artificial Sequence
  Synthetic
cucuugcucuagaugac

SEQ ID NO: 968 - RNA, 17 nt, Artificial Sequence
  Synthetic
cucuuuggcaaaagcag

SEQ ID NO: 969 - RNA, 17 nt, Artificial Sequence
  Synthetic
cucuuuggcaaaagcag

SEQ ID NO: 970 - RNA, 17 nt, Artificial Sequence
  Synthetic
cugaacaaguuuugaaa

SEQ ID NO: 971 - RNA, 17 nt, Artificial Sequence
  Synthetic
cugagcaaaacaacugg

SEQ ID NO: 972 - RNA, 17 nt, Artificial Sequence
  Synthetic
cugcugcuuuugccaaa

SEQ ID NO: 973 - RNA, 17 nt, Artificial Sequence
  Synthetic
cuggagaggauaggaca

SEQ ID NO: 974 - RNA, 17 nt, Artificial Sequence
  Synthetic
uaaaugaaaacguuguu

SEQ ID NO: 975 - RNA, 17 nt, Artificial Sequence
  Synthetic
uaagcauacuuuuuuua

SEQ ID NO: 976 - RNA, 17 nt, Artificial Sequence
  Synthetic
uaaugccugaacaaguu

SEQ ID NO: 977 - RNA, 17 nt, Artificial Sequence
  Synthetic
uaauuuguuucugugug

SEQ ID NO: 978 - RNA, 17 nt, Artificial Sequence
  Synthetic
uacaaaagaacauacau

SEQ ID NO: 979 - RNA, 17 nt, Artificial Sequence
  Synthetic
uaggcaagagacaucuu

SEQ ID NO: 980 - RNA, 17 nt, Artificial Sequence
  Synthetic
uauaagucuuuugauau

SEQ ID NO: 981 - RNA, 17 nt, Artificial Sequence
  Synthetic
uaucuaagauccuuuca

SEQ ID NO: 982 - RNA, 17 nt, Artificial Sequence
  Synthetic
uauuucugaugaggaag

SEQ ID NO: 983 - RNA, 17 nt, Artificial Sequence
  Synthetic
uccaguuguuuugcuca

SEQ ID NO: 984 - RNA, 17 nt, Artificial Sequence
  Synthetic
ucuaaugcuggagagga

SEQ ID NO: 985 - RNA, 17 nt, Artificial Sequence
  Synthetic
ugaacaaguuuugaaac

SEQ ID NO: 986 - RNA, 17 nt, Artificial Sequence
  Synthetic
ugagccagcaaaagcuu

SEQ ID NO: 987 - RNA, 17 nt, Artificial Sequence
  Synthetic
ugcagaacuaguguaga

SEQ ID NO: 988 - RNA, 17 nt, Artificial Sequence
  Synthetic
ugcucuuuucuauauau

SEQ ID NO: 989 - RNA, 17 nt, Artificial Sequence
  Synthetic
ugcuggagaggauagga

SEQ ID NO: 990 - RNA, 17 nt, Artificial Sequence
  Synthetic
uguuuaucaauauuauu

SEQ ID NO: 991 - RNA, 17 nt, Artificial Sequence
  Synthetic
uuaaaaaaaguaugcuu

SEQ ID NO: 992 - RNA, 17 nt, Artificial Sequence
  Synthetic
uuaaggcggggagucac

SEQ ID NO: 993 - RNA, 17 nt, Artificial Sequence
  Synthetic
uuacugaaugugucucu

SEQ ID NO: 994 - RNA, 17 nt, Artificial Sequence
  Synthetic
uuauucuacuccuguga

SEQ ID NO: 995 - RNA, 17 nt, Artificial Sequence
  Synthetic
uucacugagcaaaacaa

SEQ ID NO: 996 - RNA, 17 nt, Artificial Sequence
  Synthetic
uucugcugcuuuugcca

SEQ ID NO: 997 - RNA, 17 nt, Artificial Sequence
  Synthetic
uugaacucugugccaaa

SEQ ID NO: 998 - RNA, 17 nt, Artificial Sequence
  Synthetic
uugacaguuuuuaaggc

SEQ ID NO: 999 - RNA, 17 nt, Artificial Sequence
  Synthetic
uuguggauaauguauca

SEQ ID NO: 1000 - RNA, 17 nt, Artificial Sequence
  Synthetic
uuguucaucuuccucau

SEQ ID NO: 1001 - RNA, 17 nt, Artificial Sequence
  Synthetic
uuguucugaguagcuuu

SEQ ID NO: 1002 - RNA, 17 nt, Artificial Sequence
  Synthetic
uuugacaguuuuuaagg

SEQ ID NO: 1003 - RNA, 17 nt, Artificial Sequence
  Synthetic
uuuugacaguuuuuaag

SEQ ID NO: 1004 - RNA, 17 nt, Artificial Sequence
  Synthetic
uucaagcuaauacauga

SEQ ID NO: 1005 - RNA, 17 nt, Artificial Sequence
  Synthetic
cacaugggagucacagg

SEQ ID NO: 1006 - RNA, 20 nt, Artificial Sequence
  Synthetic
agucacaugggagucacagg

SEQ ID NO: 1007 - RNA, 17 nt, Artificial Sequence
  Synthetic
aauagaggcuuauggau

SEQ ID NO: 1008 - RNA, 17 nt, Artificial Sequence
  Synthetic
cugaggacagaacaagc

SEQ ID NO: 1009 - RNA, 17 nt, Artificial Sequence
  Synthetic
caucagaaauagaggcu

SEQ ID NO: 1010 - RNA, 17 nt, Artificial Sequence
  Synthetic
cugcuuuugccaaagag

SEQ ID NO: 1011 - RNA, 17 nt, Artificial Sequence
  Synthetic
agcagaaagcaaacuga

SEQ ID NO: 1012 - RNA, 17 nt, Artificial Sequence
  Synthetic
aaaagcagcagaaagca

SEQ ID NO: 1013 - RNA, 20 nt, Artificial Sequence
  Synthetic
uuacugaggacagaacaagc

SEQ ID NO: 1014 - RNA, 20 nt, Artificial Sequence
  Synthetic
aacguuguucugaguagcuu

SEQ ID NO: 1015 - RNA, 20 nt, Artificial Sequence
  Synthetic
cugcugcuuuugccaaagag

SEQ ID NO: 1016 - RNA, 20 nt, Artificial Sequence
  Synthetic
agaaauagaggcuuauggau

SEQ ID NO: 1017 - RNA, 20 nt, Artificial Sequence
  Synthetic
ccucaucagaaauagaggcu

SEQ ID NO: 1018 - RNA, 20 nt, Artificial Sequence
  Synthetic
agcagcagaaagcaaacuga

SEQ ID NO: 1019 - RNA, 17 nt, Artificial Sequence
  Synthetic
cugcuuuugccaaagag

SEQ ID NO: 1020 - RNA, 17 nt, Artificial Sequence
  Synthetic
agcagaaagcaaacuga

SEQ ID NO: 1021 - RNA, 17 nt, Artificial Sequence
  Synthetic
aaaagcagcagaaagca

SEQ ID NO: 1022 - RNA, 20 nt, Artificial Sequence
  Synthetic
aacguuguucugaguagcuu

SEQ ID NO: 1023 - RNA, 20 nt, Artificial Sequence
  Synthetic
cugcugcuuuugccaaagag

SEQ ID NO: 1024 - RNA, 20 nt, Artificial Sequence
  Synthetic
agcagcagaaagcaaacuga

SEQ ID NO: 1025 - RNA, 24 nt, Artificial Sequence
  Synthetic
aaauaaaacuaagacacugccaau

SEQ ID NO: 1026 - RNA, 23 nt, Artificial Sequence
  Synthetic
aauaaaacuaagacacugccaau

SEQ ID NO: 1027 - RNA, 22 nt, Artificial Sequence
  Synthetic
auaaaacuaagacacugccaau

SEQ ID NO: 1028 - RNA, 19 nt, Artificial Sequence
  Synthetic
aaacuaagacacugccaau

SEQ ID NO: 1029 - RNA, 18 nt, Artificial Sequence
  Synthetic
aacuaagacacugccaau

SEQ ID NO: 1030 - RNA, 24 nt, Artificial Sequence
  Synthetic
ccgcaccuggccccaguuguaauu

SEQ ID NO: 1031 - RNA, 23 nt, Artificial Sequence
  Synthetic
cgcaccuggccccaguuguaauu

SEQ ID NO: 1032 - RNA, 21 nt, Artificial Sequence
  Synthetic
caccuggccccaguuguaauu

SEQ ID NO: 1033 - RNA, 19 nt, Artificial Sequence
  Synthetic
ccuggccccaguuguaauu

SEQ ID NO: 1034 - RNA, 18 nt, Artificial Sequence
  Synthetic
cuggccccaguuguaauu

SEQ ID NO: 1035 - RNA, 21 nt, Artificial Sequence
  Synthetic
uaaaacuaagacacugccaau

SEQ ID NO: 1036 - RNA, 24 nt, Artificial Sequence
  Synthetic
aaaauaaaacuaagacacugccaa

SEQ ID NO: 1037 - RNA, 23 nt, Artificial Sequence
  Synthetic
aaauaaaacuaagacacugccaa

SEQ ID NO: 1038 - RNA, 22 nt, Artificial Sequence
  Synthetic
aauaaaacuaagacacugccaa

SEQ ID NO: 1039 - RNA, 21 nt, Artificial Sequence
  Synthetic
auaaaacuaagacacugccaa

SEQ ID NO: 1040 - RNA, 19 nt, Artificial Sequence
  Synthetic
aaaacuaagacacugccaa

SEQ ID NO: 1041 - RNA, 18 nt, Artificial Sequence
  Synthetic
aaacuaagacacugccaa

SEQ ID NO: 1042 - RNA, 24 nt, Artificial Sequence
  Synthetic
aagacacugccaauagggauaggu

SEQ ID NO: 1043 - RNA, 23 nt, Artificial Sequence
  Synthetic
agacacugccaauagggauaggu

SEQ ID NO: 1044 - RNA, 21 nt, Artificial Sequence
  Synthetic
acacugccaauagggauaggu

SEQ ID NO: 1045 - RNA, 19 nt, Artificial Sequence
  Synthetic
acugccaauagggauaggu

SEQ ID NO: 1046 - RNA, 18 nt, Artificial Sequence
  Synthetic
cugccaauagggauaggu

SEQ ID NO: 1047 - RNA, 22 nt, Artificial Sequence
  Synthetic
gacacugccaauagggauaggu

SEQ ID NO: 1048 - RNA, 20 nt, Artificial Sequence
  Synthetic
uaaaacuaagacacugccaa

SEQ ID NO: 1049 - RNA, 22 nt, Artificial Sequence
  Synthetic
augagauacucacaauuacaac

SEQ ID NO: 1050 - RNA, 19 nt, Artificial Sequence
  Synthetic
agauacucacaauuacaac

SEQ ID NO: 1051 - RNA, 24 nt, Artificial Sequence
  Synthetic
guaugagauacucacaauuacaac

SEQ ID NO: 1052 - RNA, 18 nt, Artificial Sequence
  Synthetic
gauacucacaauuacaac

SEQ ID NO: 1053 - RNA, 23 nt, Artificial Sequence
  Synthetic
uaugagauacucacaauuacaac

SEQ ID NO: 1054 - RNA, 21 nt, Artificial Sequence
  Synthetic
ugagauacucacaauuacaac

SEQ ID NO: 1055 - RNA, 21 nt, Artificial Sequence
  Synthetic
augagauauucacaauuacaa

SEQ ID NO: 1056 - RNA, 18 nt, Artificial Sequence
  Synthetic
agauauucacaauuacaa

SEQ ID NO: 1057 - RNA, 24 nt, Artificial Sequence
  Synthetic
gguaugagauauucacaauuacaa

SEQ ID NO: 1058 - RNA, 23 nt, Artificial Sequence
  Synthetic
guaugagauauucacaauuacaa

SEQ ID NO: 1059 - RNA, 19 nt, Artificial Sequence
  Synthetic
gagauauucacaauuacaa

SEQ ID NO: 1060 - RNA, 22 nt, Artificial Sequence
  Synthetic
uaugagauauucacaauuacaa

SEQ ID NO: 1061 - RNA, 20 nt, Artificial Sequence
  Synthetic
ugagauauucacaauuacaa

SEQ ID NO: 1062 - RNA, 17 nt, Artificial Sequence
  Synthetic
aaaaaggagcaugaaac

SEQ ID NO: 1063 - RNA, 20 nt, Artificial Sequence
  Synthetic
aaaagacuuauauuccauua

SEQ ID NO: 1064 - RNA, 20 nt, Artificial Sequence
  Synthetic
aaaauuaugccuauuuagug

SEQ ID NO: 1065 - RNA, 20 nt, Artificial Sequence
  Synthetic
aaacaacuggaagagagaaa

SEQ ID NO: 1066 - RNA, 20 nt, Artificial Sequence
  Synthetic
aaagaaauagauguagauug

SEQ ID NO: 1067 - RNA, 20 nt, Artificial Sequence
  Synthetic
aaagaugaaaaauacucuuu

SEQ ID NO: 1068 - RNA, 20 nt, Artificial Sequence
  Synthetic
aaauagaggcuuauggauuu

SEQ ID NO: 1069 - RNA, 20 nt, Artificial Sequence
  Synthetic
aaauuaucaccacacuaaau

SEQ ID NO: 1070 - RNA, 17 nt, Artificial Sequence
  Synthetic
aacaaacuauucuccca

SEQ ID NO: 1071 - RNA, 20 nt, Artificial Sequence
  Synthetic
aacaguagcugaaauauuaa

SEQ ID NO: 1072 - RNA, 20 nt, Artificial Sequence
  Synthetic
aacaugacucauaauuuagu

SEQ ID NO: 1073 - RNA, 20 nt, Artificial Sequence
  Synthetic
aacuauucucccaugguccc

SEQ ID NO: 1074 - RNA, 20 nt, Artificial Sequence
  Synthetic
aaggaaauacaaaaacugga

SEQ ID NO: 1075 - RNA, 17 nt, Artificial Sequence
  Synthetic
aagguauagaguucaag

SEQ ID NO: 1076 - RNA, 17 nt, Artificial Sequence
  Synthetic
aagguucaugagacuag

SEQ ID NO: 1077 - RNA, 20 nt, Artificial Sequence
  Synthetic
aauaguuuguucuggguaca

SEQ ID NO: 1078 - RNA, 20 nt, Artificial Sequence
  Synthetic
aauauaagucuuuugauaua

SEQ ID NO: 1079 - RNA, 20 nt, Artificial Sequence
  Synthetic
aauauauuaucuauuuauag

SEQ ID NO: 1080 - RNA, 17 nt, Artificial Sequence
  Synthetic
aauauuguaaucaaagg

SEQ ID NO: 1081 - RNA, 17 nt, Artificial Sequence
  Synthetic
aauauuucagcuacugu

SEQ ID NO: 1082 - RNA, 20 nt, Artificial Sequence
  Synthetic
aauuauuguugcuuuuugag

SEQ ID NO: 1083 - RNA, 20 nt, Artificial Sequence
  Synthetic
aauucacugagcaaaacaac

SEQ ID NO: 1084 - RNA, 17 nt, Artificial Sequence
  Synthetic
acaaaagccagggacca

SEQ ID NO: 1085 - RNA, 20 nt, Artificial Sequence
  Synthetic
acagagugcauccauggucc

SEQ ID NO: 1086 - RNA, 17 nt, Artificial Sequence
  Synthetic
acauaaucaccucucuu

SEQ ID NO: 1087 - RNA, 20 nt, Artificial Sequence
  Synthetic
accagacaucuaagagaaaa

SEQ ID NO: 1088 - RNA, 17 nt, Artificial Sequence
  Synthetic
acuuucuaaugcuggag

SEQ ID NO: 1089 - RNA, 20 nt, Artificial Sequence
  Synthetic
agaauauuguaaucaaagga

SEQ ID NO: 1090 - RNA, 17 nt, Artificial Sequence
  Synthetic
agacaucuaagagaaaa

SEQ ID NO: 1091 - RNA, 20 nt, Artificial Sequence
  Synthetic
agaggauaggacagaggaca

SEQ ID NO: 1092 - RNA, 20 nt, Artificial Sequence
  Synthetic
agaugacaugagguaaguag

SEQ ID NO: 1093 - RNA, 17 nt, Artificial Sequence
  Synthetic
agaugucugguuaaaag

SEQ ID NO: 1094 - RNA, 17 nt, Artificial Sequence
  Synthetic
agccucuauuucugaug

SEQ ID NO: 1095 - RNA, 17 nt, Artificial Sequence
  Synthetic
agcucaaaagcuuuugc

SEQ ID NO: 1096 - RNA, 20 nt, Artificial Sequence
  Synthetic
aggaaauacaaaaacuggau

SEQ ID NO: 1097 - RNA, 17 nt, Artificial Sequence
  Synthetic
aggaagaugaacaaauc

SEQ ID NO: 1098 - RNA, 20 nt, Artificial Sequence
  Synthetic
aggacagaggacauggagaa

SEQ ID NO: 1099 - RNA, 20 nt, Artificial Sequence
  Synthetic
aggacuuucuaaugcuggag

SEQ ID NO: 1100 - RNA, 17 nt, Artificial Sequence
  Synthetic
aggcaagagacaucuug

SEQ ID NO: 1101 - RNA, 20 nt, Artificial Sequence
  Synthetic
agguagaauauuguaaucaa

SEQ ID NO: 1102 - RNA, 17 nt, Artificial Sequence
  Synthetic
aguagcugaaauauuaa

SEQ ID NO: 1103 - RNA, 17 nt, Artificial Sequence
  Synthetic
aguuuguucuggguaca

SEQ ID NO: 1104 - RNA, 20 nt, Artificial Sequence
  Synthetic
auaagccucuauuucugaug

SEQ ID NO: 1105 - RNA, 17 nt, Artificial Sequence
  Synthetic
auaagucuuuugauaua

SEQ ID NO: 1106 - RNA, 20 nt, Artificial Sequence
  Synthetic
auacauaagaaagaacacug

SEQ ID NO: 1107 - RNA, 20 nt, Artificial Sequence
  Synthetic
auaguuuguucuggguacag

SEQ ID NO: 1108 - RNA, 17 nt, Artificial Sequence
  Synthetic
auaucugucuuccuuaa

SEQ ID NO: 1109 - RNA, 17 nt, Artificial Sequence
  Synthetic
auauuaagggcucuucc

SEQ ID NO: 1110 - RNA, 17 nt, Artificial Sequence
  Synthetic
auauuguaaucaaagga

SEQ ID NO: 1111 - RNA, 17 nt, Artificial Sequence
  Synthetic
aucaugcaagugaccua

SEQ ID NO: 1112 - RNA, 17 nt, Artificial Sequence
  Synthetic
aucuaagauccuuucac

SEQ ID NO: 1113 - RNA, 20 nt, Artificial Sequence
  Synthetic
aucuuccucaucagaaauag

SEQ ID NO: 1114 - RNA, 17 nt, Artificial Sequence
  Synthetic
augacucauaauuuagu

SEQ ID NO: 1115 - RNA, 20 nt, Artificial Sequence
  Synthetic
augaggaagaugaacaaauc

SEQ ID NO: 1116 - RNA, 20 nt, Artificial Sequence
  Synthetic
augggagaauaguuuguucu

SEQ ID NO: 1117 - RNA, 17 nt, Artificial Sequence
  Synthetic
auuaugccuauuuagug

SEQ ID NO: 1118 - RNA, 20 nt, Artificial Sequence
  Synthetic
auuccaaggaacaaaagcca

SEQ ID NO: 1119 - RNA, 20 nt, Artificial Sequence
  Synthetic
auugagguagaaucaagaag

SEQ ID NO: 1120 - RNA, 17 nt, Artificial Sequence
  Synthetic
caaaagccagggaccau

SEQ ID NO: 1121 - RNA, 20 nt, Artificial Sequence
  Synthetic
caacaguagcugaaauauua

SEQ ID NO: 1122 - RNA, 17 nt, Artificial Sequence
  Synthetic
caagaugucucuugccu

SEQ ID NO: 1123 - RNA, 20 nt, Artificial Sequence
  Synthetic
cagaacaaacuauucuccca

SEQ ID NO: 1124 - RNA, 20 nt, Artificial Sequence
  Synthetic
cagauuucaugugugaagaa

SEQ ID NO: 1125 - RNA, 17 nt, Artificial Sequence
  Synthetic
cagcauuagaaaguccu

SEQ ID NO: 1126 - RNA, 20 nt, Artificial Sequence
  Synthetic
cagggguaagagaaagggau

SEQ ID NO: 1127 - RNA, 20 nt, Artificial Sequence
  Synthetic
caguaaggaggauguaagac

SEQ ID NO: 1128 - RNA, 17 nt, Artificial Sequence
  Synthetic
caguagcugaaauauua

SEQ ID NO: 1129 - RNA, 17 nt, Artificial Sequence
  Synthetic
cauaagaaagaacacug

SEQ ID NO: 1130 - RNA, 20 nt, Artificial Sequence
  Synthetic
caugggagaauaguuuguuc

SEQ ID NO: 1131 - RNA, 20 nt, Artificial Sequence
  Synthetic
cauuccaaggaacaaaagcc

SEQ ID NO: 1132 - RNA, 17 nt, Artificial Sequence
  Synthetic
cuaaugcuggagaggau

SEQ ID NO: 1133 - RNA, 20 nt, Artificial Sequence
  Synthetic
cuagaugacaugagguaagu

SEQ ID NO: 1134 - RNA, 17 nt, Artificial Sequence
  Synthetic
cuaggacuuucuaaugc

SEQ ID NO: 1135 - RNA, 20 nt, Artificial Sequence
  Synthetic
cuccagcauuagaaaguccu

SEQ ID NO: 1136 - RNA, 17 nt, Artificial Sequence
  Synthetic
cucuauaccuuuuacug

SEQ ID NO: 1137 - RNA, 20 nt, Artificial Sequence
  Synthetic
cucuugcucuagaugacaug

SEQ ID NO: 1138 - RNA, 20 nt, Artificial Sequence
  Synthetic
cugcugcuuuugccaaagag

SEQ ID NO: 1139 - RNA, 17 nt, Artificial Sequence
  Synthetic
cugcuuuugccaaagag

SEQ ID NO: 1140 - RNA, 20 nt, Artificial Sequence
  Synthetic
cuggcuuuuguuccuuggaa

SEQ ID NO: 1141 - RNA, 17 nt, Artificial Sequence
  Synthetic
cuguaagauaacuacaa

SEQ ID NO: 1142 - RNA, 20 nt, Artificial Sequence
  Synthetic
cuuaagcauacuuuuuuuaa

SEQ ID NO: 1143 - RNA, 20 nt, Artificial Sequence
  Synthetic
cuuaauauuucagcuacugu

SEQ ID NO: 1144 - RNA, 20 nt, Artificial Sequence
  Synthetic
cuuagaugucugguuaaaag

SEQ ID NO: 1145 - RNA, 20 nt, Artificial Sequence
  Synthetic
cuuaucuaagauccuuucac

SEQ ID NO: 1146 - RNA, 20 nt, Artificial Sequence
  Synthetic
cuuguucuguccucaguaaa

SEQ ID NO: 1147 - RNA, 20 nt, Artificial Sequence
  Synthetic
cuuuugacaguuuuuaaggc

SEQ ID NO: 1148 - RNA, 17 nt, Artificial Sequence
  Synthetic
gaaauacaaaaacugga

SEQ ID NO: 1149 - RNA, 20 nt, Artificial Sequence
  Synthetic
ggagugcaguggagugaucu

SEQ ID NO: 1150 - RNA, 17 nt, Artificial Sequence
  Synthetic
gggguaagagaaaggga

SEQ ID NO: 1151 - RNA, 17 nt, Artificial Sequence
  Synthetic
ggguaagagaaagggau

SEQ ID NO: 1152 - RNA, 17 nt, Artificial Sequence
  Synthetic
gucucacuguguugccc

SEQ ID NO: 1153 - RNA, 17 nt, Artificial Sequence
  Synthetic
gugcaguggagugaucu

SEQ ID NO: 1154 - RNA, 20 nt, Artificial Sequence
  Synthetic
guguguguguguguguuaug

SEQ ID NO: 1155 - RNA, 17 nt, Artificial Sequence
  Synthetic
guguguguguguuaugu

SEQ ID NO: 1156 - RNA, 17 nt, Artificial Sequence
  Synthetic
aaauacaaaaacuggau

SEQ ID NO: 1157 - RNA, 17 nt, Artificial Sequence
  Synthetic
aagcauacuuuuuuuaa

SEQ ID NO: 1158 - RNA, 20 nt, Artificial Sequence
  Synthetic
aaguaugcuuaagaaaaaaa

SEQ ID NO: 1159 - RNA, 17 nt, Artificial Sequence
  Synthetic
acagaggacauggagaa

SEQ ID NO: 1160 - RNA, 20 nt, Artificial Sequence
  Synthetic
acagggguaagagaaaggga

SEQ ID NO: 1161 - RNA, 20 nt, Artificial Sequence
  Synthetic
acuccacugcacuccagccu

SEQ ID NO: 1162 - RNA, 17 nt, Artificial Sequence
  Synthetic
agacuggagauagagac

SEQ ID NO: 1163 - RNA, 20 nt, Artificial Sequence
  Synthetic
agagucucacuguguugccc

SEQ ID NO: 1164 - RNA, 17 nt, Artificial Sequence
  Synthetic
agaugaaaaauacucuu

SEQ ID NO: 1165 - RNA, 17 nt, Artificial Sequence
  Synthetic
auauuaucuauuuauag

SEQ ID NO: 1166 - RNA, 17 nt, Artificial Sequence
  Synthetic
auuucaugugugaagaa

SEQ ID NO: 1167 - RNA, 20 nt, Artificial Sequence
  Synthetic
auuuuuuauuaucuuuauug

SEQ ID NO: 1168 - RNA, 17 nt, Artificial Sequence
  Synthetic
caacuggaagagagaaa

SEQ ID NO: 1169 - RNA, 20 nt, Artificial Sequence
  Synthetic
cacuccacugcacuccagcc

SEQ ID NO: 1170 - RNA, 17 nt, Artificial Sequence
  Synthetic
cacuguguugcccaggc

SEQ ID NO: 1171 - RNA, 17 nt, Artificial Sequence
  Synthetic
ccaaggaacaaaagcca

SEQ ID NO: 1172 - RNA, 17 nt, Artificial Sequence
  Synthetic
ccacugcacuccagccu

SEQ ID NO: 1173 - RNA, 17 nt, Artificial Sequence
  Synthetic
cccaggcuggagugcag

SEQ ID NO: 1174 - RNA, 17 nt, Artificial Sequence
  Synthetic
cccuggcuuuuguuccu

SEQ ID NO: 1175 - RNA, 20 nt, Artificial Sequence
  Synthetic
cgcuugaaccugggaggcag

SEQ ID NO: 1176 - RNA, 17 nt, Artificial Sequence
  Synthetic
uaaggaaauacaaaaac

SEQ ID NO: 1177 - RNA, 20 nt, Artificial Sequence
  Synthetic
uaauaaggaaauacaaaaac

SEQ ID NO: 1178 - RNA, 20 nt, Artificial Sequence
  Synthetic
uacugcaaccucugccuccc

SEQ ID NO: 1179 - RNA, 17 nt, Artificial Sequence
  Synthetic
uaugcuuaagaaaaaaa

SEQ ID NO: 1180 - RNA, 20 nt, Artificial Sequence
  Synthetic
ucauucuuguggcaguaagg

SEQ ID NO: 1181 - RNA, 17 nt, Artificial Sequence
  Synthetic
uccacugcacuccagcc

SEQ ID NO: 1182 - RNA, 20 nt, Artificial Sequence
  Synthetic
ucucacuguguugcccaggc

SEQ ID NO: 1183 - RNA, 17 nt, Artificial Sequence
  Synthetic
ugaacaaguuuugaaac

SEQ ID NO: 1184 - RNA, 17 nt, Artificial Sequence
  Synthetic
ugcaaccucugccuccc

SEQ ID NO: 1185 - RNA, 20 nt, Artificial Sequence
  Synthetic
uguguguguguguguuaugu

SEQ ID NO: 1186 - RNA, 17 nt, Artificial Sequence
  Synthetic
uguguguguguguuaug

SEQ ID NO: 1187 - RNA, 17 nt, Artificial Sequence
  Synthetic
uucuuguggcaguaagg

SEQ ID NO: 1188 - RNA, 17 nt, Artificial Sequence
  Synthetic
uugaaccugggaggcag

SEQ ID NO: 1189 - RNA, 20 nt, Artificial Sequence
  Synthetic
uugcccaggcuggagugcag

SEQ ID NO: 1190 - RNA, 17 nt, Artificial Sequence
  Synthetic
uuuuauuaucuuuauug

SEQ ID NO: 1191 - RNA, 21 nt, Artificial Sequence
  Synthetic
aaaucaugcaagugaccuaag

SEQ ID NO: 1192 - RNA, 20 nt, Artificial Sequence
  Synthetic
aaucaugcaagugaccuaag

SEQ ID NO: 1193 - RNA, 19 nt, Artificial Sequence
  Synthetic
aucaugcaagugaccuaag

SEQ ID NO: 1194 - RNA, 20 nt, Artificial Sequence
  Synthetic
aggucacuugcaugauuuag

SEQ ID NO: 1195 - RNA, 24 nt, Artificial Sequence
  Synthetic
aauauuaagggcucuuccuggacc

SEQ ID NO: 1196 - RNA, 23 nt, Artificial Sequence
  Synthetic
auauuaagggcucuuccuggacc

SEQ ID NO: 1197 - RNA, 21 nt, Artificial Sequence
  Synthetic
auuaagggcucuuccuggacc

SEQ ID NO: 1198 - RNA, 18 nt, Artificial Sequence
  Synthetic
aagggcucuuccuggacc

SEQ ID NO: 1199 - RNA, 19 nt, Artificial Sequence
  Synthetic
aggacuuucuaaugcugga

SEQ ID NO: 1200 - RNA, 21 nt, Artificial Sequence
  Synthetic
accaugggagaauaguuuguu

SEQ ID NO: 1201 - RNA, 18 nt, Artificial Sequence
  Synthetic
augggagaauaguuuguu

SEQ ID NO: 1202 - RNA, 23 nt, Artificial Sequence
  Synthetic
acuccugugaaaggaucuuagau

SEQ ID NO: 1203 - RNA, 23 nt, Artificial Sequence
  Synthetic
aaaacguuguucugaguagcuuu

SEQ ID NO: 1204 - RNA, 22 nt, Artificial Sequence
  Synthetic
aaacguuguucugaguagcuuu

SEQ ID NO: 1205 - RNA, 21 nt, Artificial Sequence
  Synthetic
aacguuguucugaguagcuuu

SEQ ID NO: 1206 - RNA, 20 nt, Artificial Sequence
  Synthetic
acguuguucugaguagcuuu

SEQ ID NO: 1207 - RNA, 22 nt, Artificial Sequence
  Synthetic
auuuauaguggcugaaugacuu

SEQ ID NO: 1208 - RNA, 18 nt, Artificial Sequence
  Synthetic
auaguggcugaaugacuu

SEQ ID NO: 1209 - RNA, 22 nt, Artificial Sequence
  Synthetic
auggucccuggcuuuuguuccu

SEQ ID NO: 1210 - RNA, 24 nt, Artificial Sequence
  Synthetic
agacaucuuguggauaauguauca

SEQ ID NO: 1211 - RNA, 22 nt, Artificial Sequence
  Synthetic
acaucuuguggauaauguauca

SEQ ID NO: 1212 - RNA, 20 nt, Artificial Sequence
  Synthetic
aucuuguggauaauguauca

SEQ ID NO: 1213 - RNA, 24 nt, Artificial Sequence
  Synthetic
aaaguccuaggcaagagacaucuu

SEQ ID NO: 1214 - RNA, 23 nt, Artificial Sequence
  Synthetic
aaguccuaggcaagagacaucuu

SEQ ID NO: 1215 - RNA, 22 nt, Artificial Sequence
  Synthetic
aguccuaggcaagagacaucuu

SEQ ID NO: 1216 - RNA, 24 nt, Artificial Sequence
  Synthetic
agccagcaaaagcuuuugagcuaa

SEQ ID NO: 1217 - RNA, 20 nt, Artificial Sequence
  Synthetic
agcaaaagcuuuugagcuaa

SEQ ID NO: 1218 - RNA, 22 nt, Artificial Sequence
  Synthetic
agaucuuauucuacuccuguga

SEQ ID NO: 1219 - RNA, 20 nt, Artificial Sequence
  Synthetic
aucuuauucuacuccuguga

SEQ ID NO: 1220 - RNA, 22 nt, Artificial Sequence
  Synthetic
aucuaagauccuuucacaggag

SEQ ID NO: 1221 - RNA, 18 nt, Artificial Sequence
  Synthetic
aagauccuuucacaggag

SEQ ID NO: 1222 - RNA, 24 nt, Artificial Sequence
  Synthetic
agcuuucaggauuccuacuaaauu

SEQ ID NO: 1223 - RNA, 23 nt, Artificial Sequence
  Synthetic
acucagaacaacguuuucauuua

SEQ ID NO: 1224 - RNA, 19 nt, Artificial Sequence
  Synthetic
agaacaacguuuucauuua

SEQ ID NO: 1225 - RNA, 22 nt, Artificial Sequence
  Synthetic
agaauaucauaaguuacaaucu

SEQ ID NO: 1226 - RNA, 20 nt, Artificial Sequence
  Synthetic
aauaucauaaguuacaaucu

SEQ ID NO: 1227 - RNA, 19 nt, Artificial Sequence
  Synthetic
auaucauaaguuacaaucu

SEQ ID NO: 1228 - RNA, 22 nt, Artificial Sequence
  Synthetic
aaguggcuguaagauaacuaca

SEQ ID NO: 1229 - RNA, 21 nt, Artificial Sequence
  Synthetic
aguggcuguaagauaacuaca

SEQ ID NO: 1230 - RNA, 24 nt, Artificial Sequence
  Synthetic
auguuuaacguuaucauuuuccca

SEQ ID NO: 1231 - RNA, 18 nt, Artificial Sequence
  Synthetic
aacguuaucauuuuccca

SEQ ID NO: 1232 - RNA, 22 nt, Artificial Sequence
  Synthetic
aagagaaagggaugggcacuua

SEQ ID NO: 1233 - RNA, 21 nt, Artificial Sequence
  Synthetic
agagaaagggaugggcacuua

SEQ ID NO: 1234 - RNA, 19 nt, Artificial Sequence
  Synthetic
agaaagggaugggcacuua

SEQ ID NO: 1235 - RNA, 23 nt, Artificial Sequence
  Synthetic
auucaguaaaugaaaacguuguu

SEQ ID NO: 1236 - RNA, 19 nt, Artificial Sequence
  Synthetic
aguaaaugaaaacguuguu

SEQ ID NO: 1237 - RNA, 23 nt, Artificial Sequence
  Synthetic
auaaacaugacucauaauuuagu

SEQ ID NO: 1238 - RNA, 21 nt, Artificial Sequence
  Synthetic
aaacaugacucauaauuuagu

SEQ ID NO: 1239 - RNA, 20 nt, Artificial Sequence
  Synthetic
aacaugacucauaauuuagu

SEQ ID NO: 1240 - RNA, 19 nt, Artificial Sequence
  Synthetic
acaugacucauaauuuagu

SEQ ID NO: 1241 - RNA, 23 nt, Artificial Sequence
  Synthetic
auucuuaucuaagauccuuucac

SEQ ID NO: 1242 - RNA, 24 nt, Artificial Sequence
  Synthetic
aggaacaaaagccagggaccaugg

SEQ ID NO: 1243 - RNA, 21 nt, Artificial Sequence
  Synthetic
aacaaaagccagggaccaugg

SEQ ID NO: 1244 - RNA, 20 nt, Artificial Sequence
  Synthetic
acaaaagccagggaccaugg

SEQ ID NO: 1245 - RNA, 18 nt, Artificial Sequence
  Synthetic
aaaagccagggaccaugg

SEQ ID NO: 1246 - RNA, 21 nt, Artificial Sequence
  Synthetic
agaauaguuuguucuggguac

SEQ ID NO: 1247 - RNA, 19 nt, Artificial Sequence
  Synthetic
aauaguuuguucuggguac

SEQ ID NO: 1248 - RNA, 18 nt, Artificial Sequence
  Synthetic
auaguuuguucuggguac

SEQ ID NO: 1249 - RNA, 24 nt, Artificial Sequence
  Synthetic
aucagaaauagaggcuuauggauu

SEQ ID NO: 1250 - RNA, 21 nt, Artificial Sequence
  Synthetic
agaaauagaggcuuauggauu

SEQ ID NO: 1251 - RNA, 19 nt, Artificial Sequence
  Synthetic
aaauagaggcuuauggauu

SEQ ID NO: 1252 - RNA, 18 nt, Artificial Sequence
  Synthetic
aauagaggcuuauggauu

SEQ ID NO: 1253 - RNA, 23 nt, Artificial Sequence
  Synthetic
aauauauuaucuauuuauagugg

SEQ ID NO: 1254 - RNA, 22 nt, Artificial Sequence
  Synthetic
auauauuaucuauuuauagugg

SEQ ID NO: 1255 - RNA, 20 nt, Artificial Sequence
  Synthetic
auauuaucuauuuauagugg

SEQ ID NO: 1256 - RNA, 18 nt, Artificial Sequence
  Synthetic
auuaucuauuuauagugg

SEQ ID NO: 1257 - RNA, 22 nt, Artificial Sequence
  Synthetic
aaauucucaucauuuuuuauug

SEQ ID NO: 1258 - RNA, 21 nt, Artificial Sequence
  Synthetic
aauucucaucauuuuuuauug

SEQ ID NO: 1259 - RNA, 20 nt, Artificial Sequence
  Synthetic
auucucaucauuuuuuauug

SEQ ID NO: 1260 - RNA, 22 nt, Artificial Sequence
  Synthetic
agaggauaggacagaggacaug

SEQ ID NO: 1261 - RNA, 20 nt, Artificial Sequence
  Synthetic
aggauaggacagaggacaug

SEQ ID NO: 1262 - RNA, 23 nt, Artificial Sequence
  Synthetic
agaauaaauguagaauuuuaaug

SEQ ID NO: 1263 - RNA, 21 nt, Artificial Sequence
  Synthetic
aauaaauguagaauuuuaaug

SEQ ID NO: 1264 - RNA, 20 nt, Artificial Sequence
  Synthetic
auaaauguagaauuuuaaug

SEQ ID NO: 1265 - RNA, 18 nt, Artificial Sequence
  Synthetic
aaauguagaauuuuaaug

SEQ ID NO: 1266 - RNA, 22 nt, Artificial Sequence
  Synthetic
auuuuuuauuguagaauaaaug

SEQ ID NO: 1267 - RNA, 23 nt, Artificial Sequence
  Synthetic
cuaaaucaugcaagugaccuaag

SEQ ID NO: 1268 - RNA, 24 nt, Artificial Sequence
  Synthetic
ccuuaggucacuugcaugauuuag

SEQ ID NO: 1269 - RNA, 23 nt, Artificial Sequence
  Synthetic
cuuaggucacuugcaugauuuag

SEQ ID NO: 1270 - RNA, 22 nt, Artificial Sequence
  Synthetic
ccuaggacuuucuaaugcugga

SEQ ID NO: 1271 - RNA, 21 nt, Artificial Sequence
  Synthetic
cuaggacuuucuaaugcugga

SEQ ID NO: 1272 - RNA, 20 nt, Artificial Sequence
  Synthetic
ccaugggagaauaguuuguu

SEQ ID NO: 1273 - RNA, 19 nt, Artificial Sequence
  Synthetic
caugggagaauaguuuguu

SEQ ID NO: 1274 - RNA, 22 nt, Artificial Sequence
  Synthetic
cuccugugaaaggaucuuagau

SEQ ID NO: 1275 - RNA, 20 nt, Artificial Sequence
  Synthetic
ccugugaaaggaucuuagau

SEQ ID NO: 1276 - RNA, 19 nt, Artificial Sequence
  Synthetic
cugugaaaggaucuuagau

SEQ ID NO: 1277 - RNA, 21 nt, Artificial Sequence
  Synthetic
cccuggcuuuuguuccuugga

SEQ ID NO: 1278 - RNA, 20 nt, Artificial Sequence
  Synthetic
ccuggcuuuuguuccuugga

SEQ ID NO: 1279 - RNA, 19 nt, Artificial Sequence
  Synthetic
cuggcuuuuguuccuugga

SEQ ID NO: 1280 - RNA, 19 nt, Artificial Sequence
  Synthetic
cguuguucugaguagcuuu

SEQ ID NO: 1281 - RNA, 24 nt, Artificial Sequence
  Synthetic
cuauuuauaguggcugaaugacuu

SEQ ID NO: 1282 - RNA, 24 nt, Artificial Sequence
  Synthetic
ccauggucccuggcuuuuguuccu

SEQ ID NO: 1283 - RNA, 23 nt, Artificial Sequence
  Synthetic
cauggucccuggcuuuuguuccu

SEQ ID NO: 1284 - RNA, 21 nt, Artificial Sequence
  Synthetic
caucuuguggauaauguauca

SEQ ID NO: 1285 - RNA, 18 nt, Artificial Sequence
  Synthetic
cuuguggauaauguauca

SEQ ID NO: 1286 - RNA, 19 nt, Artificial Sequence
  Synthetic
ccuaggcaagagacaucuu

SEQ ID NO: 1287 - RNA, 18 nt, Artificial Sequence
  Synthetic
cuaggcaagagacaucuu

SEQ ID NO: 1288 - RNA, 22 nt, Artificial Sequence
  Synthetic
ccagcaaaagcuuuugagcuaa

SEQ ID NO: 1289 - RNA, 21 nt, Artificial Sequence
  Synthetic
cagcaaaagcuuuugagcuaa

SEQ ID NO: 1290 - RNA, 18 nt, Artificial Sequence
  Synthetic
caaaagcuuuugagcuaa

SEQ ID NO: 1291 - RNA, 18 nt, Artificial Sequence
  Synthetic
cuuauucuacuccuguga

SEQ ID NO: 1292 - RNA, 20 nt, Artificial Sequence
  Synthetic
cuaagauccuuucacaggag

SEQ ID NO: 1293 - RNA, 24 nt, Artificial Sequence
  Synthetic
cuuccucaucagaaauagaggcuu

SEQ ID NO: 1294 - RNA, 21 nt, Artificial Sequence
  Synthetic
ccucaucagaaauagaggcuu

SEQ ID NO: 1295 - RNA, 20 nt, Artificial Sequence
  Synthetic
cucaucagaaauagaggcuu

SEQ ID NO: 1296 - RNA, 18 nt, Artificial Sequence
  Synthetic
caucagaaauagaggcuu

SEQ ID NO: 1297 - RNA, 22 nt, Artificial Sequence
  Synthetic
cuuucaggauuccuacuaaauu

SEQ ID NO: 1298 - RNA, 18 nt, Artificial Sequence
  Synthetic
caggauuccuacuaaauu

SEQ ID NO: 1299 - RNA, 19 nt, Artificial Sequence
  Synthetic
cuguccucaguaaaaggua

SEQ ID NO: 1300 - RNA, 22 nt, Artificial Sequence
  Synthetic
cucagaacaacguuuucauuua

SEQ ID NO: 1301 - RNA, 20 nt, Artificial Sequence
  Synthetic
cagaacaacguuuucauuua

SEQ ID NO: 1302 - RNA, 23 nt, Artificial Sequence
  Synthetic
caaguggcuguaagauaacuaca

SEQ ID NO: 1303 - RNA, 24 nt, Artificial Sequence
  Synthetic
cauucaguaaaugaaaacguuguu

SEQ ID NO: 1304 - RNA, 20 nt, Artificial Sequence
  Synthetic
caguaaaugaaaacguuguu

SEQ ID NO: 1305 - RNA, 18 nt, Artificial Sequence
  Synthetic
caugacucauaauuuagu

SEQ ID NO: 1306 - RNA, 20 nt, Artificial Sequence
  Synthetic
cuuaucuaagauccuuucac

SEQ ID NO: 1307 - RNA, 19 nt, Artificial Sequence
  Synthetic
caaaagccagggaccaugg

SEQ ID NO: 1308 - RNA, 22 nt, Artificial Sequence
  Synthetic
cagaaauagaggcuuauggauu

SEQ ID NO: 1309 - RNA, 21 nt, Artificial Sequence
  Synthetic
cuggguacagggguaagagaa

SEQ ID NO: 1310 - RNA, 24 nt, Artificial Sequence
  Synthetic
caauauauuaucuauuuauagugg

SEQ ID NO: 1311 - RNA, 23 nt, Artificial Sequence
  Synthetic
cauuuuuuauuguagaauaaaug

SEQ ID NO: 1312 - RNA, 22 nt, Artificial Sequence
  Synthetic
uaaaucaugcaagugaccuaag

SEQ ID NO: 1313 - RNA, 18 nt, Artificial Sequence
  Synthetic
ucaugcaagugaccuaag

SEQ ID NO: 1314 - RNA, 22 nt, Artificial Sequence
  Synthetic
uuaggucacuugcaugauuuag

SEQ ID NO: 1315 - RNA, 21 nt, Artificial Sequence
  Synthetic
uaggucacuugcaugauuuag

SEQ ID NO: 1316 - RNA, 22 nt, Artificial Sequence
  Synthetic
uauuaagggcucuuccuggacc

SEQ ID NO: 1317 - RNA, 20 nt, Artificial Sequence
  Synthetic
uuaagggcucuuccuggacc

SEQ ID NO: 1318 - RNA, 19 nt, Artificial Sequence
  Synthetic
uaagggcucuuccuggacc

SEQ ID NO: 1319 - RNA, 24 nt, Artificial Sequence
  Synthetic
ugccuaggacuuucuaaugcugga

SEQ ID NO: 1320 - RNA, 20 nt, Artificial Sequence
  Synthetic
uaggacuuucuaaugcugga

SEQ ID NO: 1321 - RNA, 24 nt, Artificial Sequence
  Synthetic
uacuccugugaaaggaucuuagau

SEQ ID NO: 1322 - RNA, 21 nt, Artificial Sequence
  Synthetic
uccugugaaaggaucuuagau

SEQ ID NO: 1323 - RNA, 18 nt, Artificial Sequence
  Synthetic
ugugaaaggaucuuagau

SEQ ID NO: 1324 - RNA, 22 nt, Artificial Sequence
  Synthetic
ucccuggcuuuuguuccuugga

SEQ ID NO: 1325 - RNA, 18 nt, Artificial Sequence
  Synthetic
uggcuuuuguuccuugga

SEQ ID NO: 1326 - RNA, 23 nt, Artificial Sequence
  Synthetic
uauuuauaguggcugaaugacuu

SEQ ID NO: 1327 - RNA, 21 nt, Artificial Sequence
  Synthetic
uuuauaguggcugaaugacuu

SEQ ID NO: 1328 - RNA, 20 nt, Artificial Sequence
  Synthetic
uuauaguggcugaaugacuu

SEQ ID NO: 1329 - RNA, 19 nt, Artificial Sequence
  Synthetic
uauaguggcugaaugacuu

SEQ ID NO: 1330 - RNA, 21 nt, Artificial Sequence
  Synthetic
uggucccuggcuuuuguuccu

SEQ ID NO: 1331 - RNA, 18 nt, Artificial Sequence
  Synthetic
ucccuggcuuuuguuccu

SEQ ID NO: 1332 - RNA, 19 nt, Artificial Sequence
  Synthetic
ucuuguggauaauguauca

SEQ ID NO: 1333 - RNA, 20 nt, Artificial Sequence
  Synthetic
uccuaggcaagagacaucuu

SEQ ID NO: 1334 - RNA, 24 nt, Artificial Sequence
  Synthetic
uuagaucuuauucuacuccuguga

SEQ ID NO: 1335 - RNA, 23 nt, Artificial Sequence
  Synthetic
uagaucuuauucuacuccuguga

SEQ ID NO: 1336 - RNA, 19 nt, Artificial Sequence
  Synthetic
ucuuauucuacuccuguga

SEQ ID NO: 1337 - RNA, 24 nt, Artificial Sequence
  Synthetic
uuaucuaagauccuuucacaggag

SEQ ID NO: 1338 - RNA, 23 nt, Artificial Sequence
  Synthetic
uaucuaagauccuuucacaggag

SEQ ID NO: 1339 - RNA, 21 nt, Artificial Sequence
  Synthetic
ucuaagauccuuucacaggag

SEQ ID NO: 1340 - RNA, 19 nt, Artificial Sequence
  Synthetic
uaagauccuuucacaggag

SEQ ID NO: 1341 - RNA, 23 nt, Artificial Sequence
  Synthetic
uuccucaucagaaauagaggcuu

SEQ ID NO: 1342 - RNA, 22 nt, Artificial Sequence
  Synthetic
uccucaucagaaauagaggcuu

SEQ ID NO: 1343 - RNA, 19 nt, Artificial Sequence
  Synthetic
ucaucagaaauagaggcuu

SEQ ID NO: 1344 - RNA, 21 nt, Artificial Sequence
  Synthetic
uuucaggauuccuacuaaauu

SEQ ID NO: 1345 - RNA, 20 nt, Artificial Sequence
  Synthetic
uucaggauuccuacuaaauu

SEQ ID NO: 1346 - RNA, 19 nt, Artificial Sequence
  Synthetic
ucaggauuccuacuaaauu

SEQ ID NO: 1347 - RNA, 24 nt, Artificial Sequence
  Synthetic
uuguucuguccucaguaaaaggua

SEQ ID NO: 1348 - RNA, 23 nt, Artificial Sequence
  Synthetic
uguucuguccucaguaaaaggua

SEQ ID NO: 1349 - RNA, 21 nt, Artificial Sequence
  Synthetic
uucuguccucaguaaaaggua

SEQ ID NO: 1350 - RNA, 20 nt, Artificial Sequence
  Synthetic
ucuguccucaguaaaaggua

SEQ ID NO: 1351 - RNA, 18 nt, Artificial Sequence
  Synthetic
uguccucaguaaaaggua

SEQ ID NO: 1352 - RNA, 24 nt, Artificial Sequence
  Synthetic
uacucagaacaacguuuucauuua

SEQ ID NO: 1353 - RNA, 21 nt, Artificial Sequence
  Synthetic
ucagaacaacguuuucauuua

SEQ ID NO: 1354 - RNA, 23 nt, Artificial Sequence
  Synthetic
uagaauaucauaaguuacaaucu

SEQ ID NO: 1355 - RNA, 18 nt, Artificial Sequence
  Synthetic
uaucauaaguuacaaucu

SEQ ID NO: 1356 - RNA, 24 nt, Artificial Sequence
  Synthetic
ucaaguggcuguaagauaacuaca

SEQ ID NO: 1357 - RNA, 19 nt, Artificial Sequence
  Synthetic
uggcuguaagauaacuaca

SEQ ID NO: 1358 - RNA, 23 nt, Artificial Sequence
  Synthetic
uguuuaacguuaucauuuuccca

SEQ ID NO: 1359 - RNA, 21 nt, Artificial Sequence
  Synthetic
uuuaacguuaucauuuuccca

SEQ ID NO: 1360 - RNA, 20 nt, Artificial Sequence
  Synthetic
uuaacguuaucauuuuccca

SEQ ID NO: 1361 - RNA, 19 nt, Artificial Sequence
  Synthetic
uaacguuaucauuuuccca

SEQ ID NO: 1362 - RNA, 23 nt, Artificial Sequence
  Synthetic
uaagagaaagggaugggcacuua

SEQ ID NO: 1363 - RNA, 22 nt, Artificial Sequence
  Synthetic
uucaguaaaugaaaacguuguu

SEQ ID NO: 1364 - RNA, 21 nt, Artificial Sequence
  Synthetic
ucaguaaaugaaaacguuguu

SEQ ID NO: 1365 - RNA, 22 nt, Artificial Sequence
  Synthetic
uaaacaugacucauaauuuagu

SEQ ID NO: 1366 - RNA, 24 nt, Artificial Sequence
  Synthetic
uauucuuaucuaagauccuuucac

SEQ ID NO: 1367 - RNA, 22 nt, Artificial Sequence
  Synthetic
uucuuaucuaagauccuuucac

SEQ ID NO: 1368 - RNA, 21 nt, Artificial Sequence
  Synthetic
ucuuaucuaagauccuuucac

SEQ ID NO: 1369 - RNA, 19 nt, Artificial Sequence
  Synthetic
uuaucuaagauccuuucac

SEQ ID NO: 1370 - RNA, 18 nt, Artificial Sequence
  Synthetic
uaucuaagauccuuucac

SEQ ID NO: 1371 - RNA, 23 nt, Artificial Sequence
  Synthetic
ucagaaauagaggcuuauggauu

SEQ ID NO: 1372 - RNA, 23 nt, Artificial Sequence
  Synthetic
uucuggguacagggguaagagaa

SEQ ID NO: 1373 - RNA, 22 nt, Artificial Sequence
  Synthetic
ucuggguacagggguaagagaa

SEQ ID NO: 1374 - RNA, 20 nt, Artificial Sequence
  Synthetic
uggguacagggguaagagaa

SEQ ID NO: 1375 - RNA, 21 nt, Artificial Sequence
  Synthetic
uauauuaucuauuuauagugg

SEQ ID NO: 1376 - RNA, 19 nt, Artificial Sequence
  Synthetic
uauuaucuauuuauagugg

SEQ ID NO: 1377 - RNA, 23 nt, Artificial Sequence
  Synthetic
uaaauucucaucauuuuuuauug

SEQ ID NO: 1378 - RNA, 19 nt, Artificial Sequence
  Synthetic
uucucaucauuuuuuauug

SEQ ID NO: 1379 - RNA, 18 nt, Artificial Sequence
  Synthetic
ucucaucauuuuuuauug

SEQ ID NO: 1380 - RNA, 24 nt, Artificial Sequence
  Synthetic
uagaauaaauguagaauuuuaaug

SEQ ID NO: 1381 - RNA, 19 nt, Artificial Sequence
  Synthetic
uaaauguagaauuuuaaug

SEQ ID NO: 1382 - RNA, 24 nt, Artificial Sequence
  Synthetic
ucauuuuuuauuguagaauaaaug

SEQ ID NO: 1383 - RNA, 21 nt, Artificial Sequence
  Synthetic
uuuuuuauuguagaauaaaug

SEQ ID NO: 1384 - RNA, 20 nt, Artificial Sequence
  Synthetic
uuuuuauuguagaauaaaug

SEQ ID NO: 1385 - RNA, 19 nt, Artificial Sequence
  Synthetic
uuuuauuguagaauaaaug

SEQ ID NO: 1386 - RNA, 18 nt, Artificial Sequence
  Synthetic
uuuauuguagaauaaaug

SEQ ID NO: 1387 - RNA, 19 nt, Artificial Sequence
  Synthetic
aaaagcuaccgguuaccug

SEQ ID NO: 1388 - RNA, 18 nt, Artificial Sequence
  Synthetic
aaagcuaccgguuaccug

SEQ ID NO: 1389 - RNA, 24 nt, Artificial Sequence
  Synthetic
aguuuuuaaggcggggagucacau

SEQ ID NO: 1390 - RNA, 19 nt, Artificial Sequence
  Synthetic
acauccuccuuacugccac

SEQ ID NO: 1391 - RNA, 23 nt, Artificial Sequence
  Synthetic
agucacaggguaggauucauguu

SEQ ID NO: 1392 - RNA, 19 nt, Artificial Sequence
  Synthetic
acaggguaggauucauguu

SEQ ID NO: 1393 - RNA, 21 nt, Artificial Sequence
  Synthetic
acagaguucaagcuaauacau

SEQ ID NO: 1394 - RNA, 19 nt, Artificial Sequence
  Synthetic
agaguucaagcuaauacau

SEQ ID NO: 1395 - RNA, 24 nt, Artificial Sequence
  Synthetic
auaagaugcagaacuaguguagac

SEQ ID NO: 1396 - RNA, 22 nt, Artificial Sequence
  Synthetic
aagaugcagaacuaguguagac

SEQ ID NO: 1397 - RNA, 21 nt, Artificial Sequence
  Synthetic
agaugcagaacuaguguagac

SEQ ID NO: 1398 - RNA, 19 nt, Artificial Sequence
  Synthetic
augcagaacuaguguagac

SEQ ID NO: 1399 - RNA, 18 nt, Artificial Sequence
  Synthetic
aguaucuccuguuuggca

SEQ ID NO: 1400 - RNA, 23 nt, Artificial Sequence
  Synthetic
acgaaaaucagauuucaugugug

SEQ ID NO: 1401 - RNA, 20 nt, Artificial Sequence
  Synthetic
aaaaucagauuucaugugug

SEQ ID NO: 1402 - RNA, 19 nt, Artificial Sequence
  Synthetic
aaaucagauuucaugugug

SEQ ID NO: 1403 - RNA, 18 nt, Artificial Sequence
  Synthetic
aaucagauuucaugugug

SEQ ID NO: 1404 - RNA, 21 nt, Artificial Sequence
  Synthetic
acaagaaugaucauucuaaac

SEQ ID NO: 1405 - RNA, 19 nt, Artificial Sequence
  Synthetic
aagaaugaucauucuaaac

SEQ ID NO: 1406 - RNA, 18 nt, Artificial Sequence
  Synthetic
agaaugaucauucuaaac

SEQ ID NO: 1407 - RNA, 24 nt, Artificial Sequence
  Synthetic
aggcggggagucacaugggaguca

SEQ ID NO: 1408 - RNA, 23 nt, Artificial Sequence
  Synthetic
agcuuuugacaguuuuuaaggcg

SEQ ID NO: 1409 - RNA, 24 nt, Artificial Sequence
  Synthetic
aaugaucauucuuguggcaguaag

SEQ ID NO: 1410 - RNA, 23 nt, Artificial Sequence
  Synthetic
augaucauucuuguggcaguaag

SEQ ID NO: 1411 - RNA, 20 nt, Artificial Sequence
  Synthetic
aucauucuuguggcaguaag

SEQ ID NO: 1412 - RNA, 23 nt, Artificial Sequence
  Synthetic
aucuagagcaagagaugaacuag

SEQ ID NO: 1413 - RNA, 19 nt, Artificial Sequence
  Synthetic
agagcaagagaugaacuag

SEQ ID NO: 1414 - RNA, 23 nt, Artificial Sequence
  Synthetic
aaugccugaacaaguuuugaaac

SEQ ID NO: 1415 - RNA, 22 nt, Artificial Sequence
  Synthetic
augccugaacaaguuuugaaac

SEQ ID NO: 1416 - RNA, 21 nt, Artificial Sequence
  Synthetic
agauugagguagaaucaagaa

SEQ ID NO: 1417 - RNA, 19 nt, Artificial Sequence
  Synthetic
auugagguagaaucaagaa

SEQ ID NO: 1418 - RNA, 22 nt, Artificial Sequence
  Synthetic
auguaagacuggagauagagac

SEQ ID NO: 1419 - RNA, 18 nt, Artificial Sequence
  Synthetic
aagacuggagauagagac

SEQ ID NO: 1420 - RNA, 21 nt, Artificial Sequence
  Synthetic
agucacaugggagucacaggg

SEQ ID NO: 1421 - RNA, 19 nt, Artificial Sequence
  Synthetic
acauaucugucuuccuuaa

SEQ ID NO: 1422 - RNA, 24 nt, Artificial Sequence
  Synthetic
aaaucagauuucaugugugaagaa

SEQ ID NO: 1423 - RNA, 23 nt, Artificial Sequence
  Synthetic
aaucagauuucaugugugaagaa

SEQ ID NO: 1424 - RNA, 22 nt, Artificial Sequence
  Synthetic
aucagauuucaugugugaagaa

SEQ ID NO: 1425 - RNA, 19 nt, Artificial Sequence
  Synthetic
agauuucaugugugaagaa

SEQ ID NO: 1426 - RNA, 24 nt, Artificial Sequence
  Synthetic
aaauaaaacuaagacacugccaau

SEQ ID NO: 1427 - RNA, 23 nt, Artificial Sequence
  Synthetic
aauaaaacuaagacacugccaau

SEQ ID NO: 1428 - RNA, 22 nt, Artificial Sequence
  Synthetic
auaaaacuaagacacugccaau

SEQ ID NO: 1429 - RNA, 19 nt, Artificial Sequence
  Synthetic
aaacuaagacacugccaau

SEQ ID NO: 1430 - RNA, 18 nt, Artificial Sequence
  Synthetic
aacuaagacacugccaau

SEQ ID NO: 1431 - RNA, 24 nt, Artificial Sequence
  Synthetic
aacuauuuaauuuguuucugugug

SEQ ID NO: 1432 - RNA, 23 nt, Artificial Sequence
  Synthetic
acuauuuaauuuguuucugugug

SEQ ID NO: 1433 - RNA, 20 nt, Artificial Sequence
  Synthetic
auuuaauuuguuucugugug

SEQ ID NO: 1434 - RNA, 24 nt, Artificial Sequence
  Synthetic
cugucaaaagcuaccgguuaccug

SEQ ID NO: 1435 - RNA, 20 nt, Artificial Sequence
  Synthetic
caaaagcuaccgguuaccug

SEQ ID NO: 1436 - RNA, 22 nt, Artificial Sequence
  Synthetic
cuuacauccuccuuacugccac

SEQ ID NO: 1437 - RNA, 18 nt, Artificial Sequence
  Synthetic
cauccuccuuacugccac

SEQ ID NO: 1438 - RNA, 20 nt, Artificial Sequence
  Synthetic
cacaggguaggauucauguu

SEQ ID NO: 1439 - RNA, 18 nt, Artificial Sequence
  Synthetic
caggguaggauucauguu

SEQ ID NO: 1440 - RNA, 22 nt, Artificial Sequence
  Synthetic
cacagaguucaagcuaauacau

SEQ ID NO: 1441 - RNA, 20 nt, Artificial Sequence
  Synthetic
cagaguucaagcuaauacau

SEQ ID NO: 1442 - RNA, 24 nt, Artificial Sequence
  Synthetic
cacgaaaaucagauuucaugugug

SEQ ID NO: 1443 - RNA, 22 nt, Artificial Sequence
  Synthetic
cgaaaaucagauuucaugugug

SEQ ID NO: 1444 - RNA, 23 nt, Artificial Sequence
  Synthetic
ccacaagaaugaucauucuaaac

SEQ ID NO: 1445 - RNA, 22 nt, Artificial Sequence
  Synthetic
cacaagaaugaucauucuaaac

SEQ ID NO: 1446 - RNA, 20 nt, Artificial Sequence
  Synthetic
caagaaugaucauucuaaac

SEQ ID NO: 1447 - RNA, 21 nt, Artificial Sequence
  Synthetic
cggggagucacaugggaguca

SEQ ID NO: 1448 - RNA, 21 nt, Artificial Sequence
  Synthetic
cuuuugacaguuuuuaaggcg

SEQ ID NO: 1449 - RNA, 18 nt, Artificial Sequence
  Synthetic
cauucuuguggcaguaag

SEQ ID NO: 1450 - RNA, 24 nt, Artificial Sequence
  Synthetic
caucuagagcaagagaugaacuag

SEQ ID NO: 1451 - RNA, 21 nt, Artificial Sequence
  Synthetic
cuagagcaagagaugaacuag

SEQ ID NO: 1452 - RNA, 19 nt, Artificial Sequence
  Synthetic
ccugaacaaguuuugaaac

SEQ ID NO: 1453 - RNA, 18 nt, Artificial Sequence
  Synthetic
cugaacaaguuuugaaac

SEQ ID NO: 1454 - RNA, 23 nt, Artificial Sequence
  Synthetic
cucucuuccaguuguuuugcuca

SEQ ID NO: 1455 - RNA, 21 nt, Artificial Sequence
  Synthetic
cucuuccaguuguuuugcuca

SEQ ID NO: 1456 - RNA, 19 nt, Artificial Sequence
  Synthetic
cuuccaguuguuuugcuca

SEQ ID NO: 1457 - RNA, 18 nt, Artificial Sequence
  Synthetic
cacaugggagucacaggg

SEQ ID NO: 1458 - RNA, 18 nt, Artificial Sequence
  Synthetic
cauaucugucuuccuuaa

SEQ ID NO: 1459 - RNA, 20 nt, Artificial Sequence
  Synthetic
cagauuucaugugugaagaa

SEQ ID NO: 1460 - RNA, 22 nt, Artificial Sequence
  Synthetic
cuauuuaauuuguuucugugug

SEQ ID NO: 1461 - RNA, 23 nt, Artificial Sequence
  Synthetic
ugucaaaagcuaccgguuaccug

SEQ ID NO: 1462 - RNA, 21 nt, Artificial Sequence
  Synthetic
ucaaaagcuaccgguuaccug

SEQ ID NO: 1463 - RNA, 22 nt, Artificial Sequence
  Synthetic
uuuuuaaggcggggagucacau

SEQ ID NO: 1464 - RNA, 21 nt, Artificial Sequence
  Synthetic
uuuuaaggcggggagucacau

SEQ ID NO: 1465 - RNA, 20 nt, Artificial Sequence
  Synthetic
uuuaaggcggggagucacau

SEQ ID NO: 1466 - RNA, 19 nt, Artificial Sequence
  Synthetic
uuaaggcggggagucacau

SEQ ID NO: 1467 - RNA, 18 nt, Artificial Sequence
  Synthetic
uaaggcggggagucacau

SEQ ID NO: 1468 - RNA, 23 nt, Artificial Sequence
  Synthetic
ucuuacauccuccuuacugccac

SEQ ID NO: 1469 - RNA, 21 nt, Artificial Sequence
  Synthetic
uuacauccuccuuacugccac

SEQ ID NO: 1470 - RNA, 20 nt, Artificial Sequence
  Synthetic
uacauccuccuuacugccac

SEQ ID NO: 1471 - RNA, 21 nt, Artificial Sequence
  Synthetic
ucacaggguaggauucauguu

SEQ ID NO: 1472 - RNA, 23 nt, Artificial Sequence
  Synthetic
uaagaugcagaacuaguguagac

SEQ ID NO: 1473 - RNA, 18 nt, Artificial Sequence
  Synthetic
ugcagaacuaguguagac

SEQ ID NO: 1474 - RNA, 23 nt, Artificial Sequence
  Synthetic
uguugaguaucuccuguuuggca

SEQ ID NO: 1475 - RNA, 21 nt, Artificial Sequence
  Synthetic
uugaguaucuccuguuuggca

SEQ ID NO: 1476 - RNA, 20 nt, Artificial Sequence
  Synthetic
ugaguaucuccuguuuggca

SEQ ID NO: 1477 - RNA, 24 nt, Artificial Sequence
  Synthetic
uagcuuuugacaguuuuuaaggcg

SEQ ID NO: 1478 - RNA, 20 nt, Artificial Sequence
  Synthetic
uuuugacaguuuuuaaggcg

SEQ ID NO: 1479 - RNA, 19 nt, Artificial Sequence
  Synthetic
uuugacaguuuuuaaggcg

SEQ ID NO: 1480 - RNA, 18 nt, Artificial Sequence
  Synthetic
uugacaguuuuuaaggcg

SEQ ID NO: 1481 - RNA, 22 nt, Artificial Sequence
  Synthetic
ugaucauucuuguggcaguaag

SEQ ID NO: 1482 - RNA, 19 nt, Artificial Sequence
  Synthetic
ucauucuuguggcaguaag

SEQ ID NO: 1483 - RNA, 22 nt, Artificial Sequence
  Synthetic
ucuagagcaagagaugaacuag

SEQ ID NO: 1484 - RNA, 20 nt, Artificial Sequence
  Synthetic
uagagcaagagaugaacuag

SEQ ID NO: 1485 - RNA, 24 nt, Artificial Sequence
  Synthetic
uaaugccugaacaaguuuugaaac

SEQ ID NO: 1486 - RNA, 21 nt, Artificial Sequence
  Synthetic
ugccugaacaaguuuugaaac

SEQ ID NO: 1487 - RNA, 24 nt, Artificial Sequence
  Synthetic
uguagauugagguagaaucaagaa

SEQ ID NO: 1488 - RNA, 22 nt, Artificial Sequence
  Synthetic
uagauugagguagaaucaagaa

SEQ ID NO: 1489 - RNA, 18 nt, Artificial Sequence
  Synthetic
uugagguagaaucaagaa

SEQ ID NO: 1490 - RNA, 21 nt, Artificial Sequence
  Synthetic
uguaagacuggagauagagac

SEQ ID NO: 1491 - RNA, 19 nt, Artificial Sequence
  Synthetic
uaagacuggagauagagac

SEQ ID NO: 1492 - RNA, 24 nt, Artificial Sequence
  Synthetic
ucucucuuccaguuguuuugcuca

SEQ ID NO: 1493 - RNA, 22 nt, Artificial Sequence
  Synthetic
ucucuuccaguuguuuugcuca

SEQ ID NO: 1494 - RNA, 20 nt, Artificial Sequence
  Synthetic
ucuuccaguuguuuugcuca

SEQ ID NO: 1495 - RNA, 18 nt, Artificial Sequence
  Synthetic
uuccaguuguuuugcuca

SEQ ID NO: 1496 - RNA, 19 nt, Artificial Sequence
  Synthetic
ucacaugggagucacaggg

SEQ ID NO: 1497 - RNA, 24 nt, Artificial Sequence
  Synthetic
uguuuacauaucugucuuccuuaa

SEQ ID NO: 1498 - RNA, 22 nt, Artificial Sequence
  Synthetic
uuuacauaucugucuuccuuaa

SEQ ID NO: 1499 - RNA, 21 nt, Artificial Sequence
  Synthetic
uuacauaucugucuuccuuaa

SEQ ID NO: 1500 - RNA, 20 nt, Artificial Sequence
  Synthetic
uacauaucugucuuccuuaa

SEQ ID NO: 1501 - RNA, 21 nt, Artificial Sequence
  Synthetic
ucagauuucaugugugaagaa

SEQ ID NO: 1502 - RNA, 21 nt, Artificial Sequence
  Synthetic
uaaaacuaagacacugccaau

SEQ ID NO: 1503 - RNA, 21 nt, Artificial Sequence
  Synthetic
uauuuaauuuguuucugugug

SEQ ID NO: 1504 - RNA, 19 nt, Artificial Sequence
  Synthetic
uuuaauuuguuucugugug

SEQ ID NO: 1505 - RNA, 18 nt, Artificial Sequence
  Synthetic
uuaauuuguuucugugug

SEQ ID NO: 1506 - RNA, 21 nt, Artificial Sequence
  Synthetic
guagaauaaauuuauuuaaug

SEQ ID NO: 1507 - RNA, 18 nt, Artificial Sequence
  Synthetic
gaauaaauuuauuuaaug

SEQ ID NO: 1508 - RNA, 23 nt, Artificial Sequence
  Synthetic
gagaaaaaggagcaugaaacagg

SEQ ID NO: 1509 - RNA, 21 nt, Artificial Sequence
  Synthetic
gaaaaaggagcaugaaacagg

SEQ ID NO: 1510 - RNA, 22 nt, Artificial Sequence
  Synthetic
guagaauaaaaaauaaaaaaac

SEQ ID NO: 1511 - RNA, 19 nt, Artificial Sequence
  Synthetic
gaauaaaaaauaaaaaaac

SEQ ID NO: 1512 - RNA, 24 nt, Artificial Sequence
  Synthetic
gaauaaaaaauaaaaaaacuagag

SEQ ID NO: 1513 - RNA, 20 nt, Artificial Sequence
  Synthetic
gaaauagauguagauugagg

SEQ ID NO: 1514 - RNA, 21 nt, Artificial Sequence
  Synthetic
gauaauaaggaaauacaaaaa

SEQ ID NO: 1515 - RNA, 23 nt, Artificial Sequence
  Synthetic
guguugcccaggcuggagugcag

SEQ ID NO: 1516 - RNA, 21 nt, Artificial Sequence
  Synthetic
guugcccaggcuggagugcag

SEQ ID NO: 1517 - RNA, 18 nt, Artificial Sequence
  Synthetic
gcccaggcuggagugcag

SEQ ID NO: 1518 - RNA, 19 nt, Artificial Sequence
  Synthetic
guuguuuuuuuuuuugaaa

SEQ ID NO: 1519 - RNA, 23 nt, Artificial Sequence
  Synthetic
gagucucacuguguugcccaggc

SEQ ID NO: 1520 - RNA, 21 nt, Artificial Sequence
  Synthetic
gucucacuguguugcccaggc

SEQ ID NO: 1521 - RNA, 24 nt, Artificial Sequence
  Synthetic
aauguagaauaaauuuauuuaaug

SEQ ID NO: 1522 - RNA, 23 nt, Artificial Sequence
  Synthetic
auguagaauaaauuuauuuaaug

SEQ ID NO: 1523 - RNA, 19 nt, Artificial Sequence
  Synthetic
agaauaaauuuauuuaaug

SEQ ID NO: 1524 - RNA, 24 nt, Artificial Sequence
  Synthetic
auuuauucuacaauaaaaaaugau

SEQ ID NO: 1525 - RNA, 20 nt, Artificial Sequence
  Synthetic
auucuacaauaaaaaaugau

SEQ ID NO: 1526 - RNA, 24 nt, Artificial Sequence
  Synthetic
agagaaaaaggagcaugaaacagg

SEQ ID NO: 1527 - RNA, 22 nt, Artificial Sequence
  Synthetic
agaaaaaggagcaugaaacagg

SEQ ID NO: 1528 - RNA, 20 nt, Artificial Sequence
  Synthetic
aaaaaggagcaugaaacagg

SEQ ID NO: 1529 - RNA, 19 nt, Artificial Sequence
  Synthetic
aaaaggagcaugaaacagg

SEQ ID NO: 1530 - RNA, 18 nt, Artificial Sequence
  Synthetic
aaaggagcaugaaacagg

SEQ ID NO: 1531 - RNA, 24 nt, Artificial Sequence
  Synthetic
acaauaaaaaaugaugagaauuua

SEQ ID NO: 1532 - RNA, 22 nt, Artificial Sequence
  Synthetic
aauaaaaaaugaugagaauuua

SEQ ID NO: 1533 - RNA, 21 nt, Artificial Sequence
  Synthetic
auaaaaaaugaugagaauuua

SEQ ID NO: 1534 - RNA, 19 nt, Artificial Sequence
  Synthetic
aaaaaaugaugagaauuua

SEQ ID NO: 1535 - RNA, 18 nt, Artificial Sequence
  Synthetic
aaaaaugaugagaauuua

SEQ ID NO: 1536 - RNA, 24 nt, Artificial Sequence
  Synthetic
auguagaauaaaaaauaaaaaaac

SEQ ID NO: 1537 - RNA, 20 nt, Artificial Sequence
  Synthetic
agaauaaaaaauaaaaaaac

SEQ ID NO: 1538 - RNA, 18 nt, Artificial Sequence
  Synthetic
aauaaaaaauaaaaaaac

SEQ ID NO: 1539 - RNA, 23 nt, Artificial Sequence
  Synthetic
aauaaaaaauaaaaaaacuagag

SEQ ID NO: 1540 - RNA, 22 nt, Artificial Sequence
  Synthetic
auaaaaaauaaaaaaacuagag

SEQ ID NO: 1541 - RNA, 20 nt, Artificial Sequence
  Synthetic
aaaaaauaaaaaaacuagag

SEQ ID NO: 1542 - RNA, 19 nt, Artificial Sequence
  Synthetic
aaaaauaaaaaaacuagag

SEQ ID NO: 1543 - RNA, 18 nt, Artificial Sequence
  Synthetic
aaaauaaaaaaacuagag

SEQ ID NO: 1544 - RNA, 23 nt, Artificial Sequence
  Synthetic
caauaaaaaaugaugagaauuua

SEQ ID NO: 1545 - RNA, 22 nt, Artificial Sequence
  Synthetic
uguagaauaaauuuauuuaaug

SEQ ID NO: 1546 - RNA, 20 nt, Artificial Sequence
  Synthetic
uagaauaaauuuauuuaaug

SEQ ID NO: 1547 - RNA, 23 nt, Artificial Sequence
  Synthetic
uuuauucuacaauaaaaaaugau

SEQ ID NO: 1548 - RNA, 22 nt, Artificial Sequence
  Synthetic
uuauucuacaauaaaaaaugau

SEQ ID NO: 1549 - RNA, 21 nt, Artificial Sequence
  Synthetic
uauucuacaauaaaaaaugau

SEQ ID NO: 1550 - RNA, 19 nt, Artificial Sequence
  Synthetic
uucuacaauaaaaaaugau

SEQ ID NO: 1551 - RNA, 18 nt, Artificial Sequence
  Synthetic
ucuacaauaaaaaaugau

SEQ ID NO: 1552 - RNA, 20 nt, Artificial Sequence
  Synthetic
uaaaaaaugaugagaauuua

SEQ ID NO: 1553 - RNA, 23 nt, Artificial Sequence
  Synthetic
uguagaauaaaaaauaaaaaaac

SEQ ID NO: 1554 - RNA, 21 nt, Artificial Sequence
  Synthetic
uagaauaaaaaauaaaaaaac

SEQ ID NO: 1555 - RNA, 21 nt, Artificial Sequence
  Synthetic
uaaaaaauaaaaaaacuagag

SEQ ID NO: 1556 - RNA, 24 nt, Artificial Sequence
  Synthetic
aaaagaaauagauguagauugagg

SEQ ID NO: 1557 - RNA, 23 nt, Artificial Sequence
  Synthetic
aaagaaauagauguagauugagg

SEQ ID NO: 1558 - RNA, 22 nt, Artificial Sequence
  Synthetic
aagaaauagauguagauugagg

SEQ ID NO: 1559 - RNA, 21 nt, Artificial Sequence
  Synthetic
agaaauagauguagauugagg

SEQ ID NO: 1560 - RNA, 19 nt, Artificial Sequence
  Synthetic
aaauagauguagauugagg

SEQ ID NO: 1561 - RNA, 18 nt, Artificial Sequence
  Synthetic
aauagauguagauugagg

SEQ ID NO: 1562 - RNA, 24 nt, Artificial Sequence
  Synthetic
auaauaaggaaauacaaaaacugg

SEQ ID NO: 1563 - RNA, 22 nt, Artificial Sequence
  Synthetic
aauaaggaaauacaaaaacugg

SEQ ID NO: 1564 - RNA, 21 nt, Artificial Sequence
  Synthetic
auaaggaaauacaaaaacugg

SEQ ID NO: 1565 - RNA, 19 nt, Artificial Sequence
  Synthetic
aaggaaauacaaaaacugg

SEQ ID NO: 1566 - RNA, 18 nt, Artificial Sequence
  Synthetic
aggaaauacaaaaacugg

SEQ ID NO: 1567 - RNA, 24 nt, Artificial Sequence
  Synthetic
auagauaauaaggaaauacaaaaa

SEQ ID NO: 1568 - RNA, 22 nt, Artificial Sequence
  Synthetic
agauaauaaggaaauacaaaaa

SEQ ID NO: 1569 - RNA, 20 nt, Artificial Sequence
  Synthetic
auaauaaggaaauacaaaaa

SEQ ID NO: 1570 - RNA, 18 nt, Artificial Sequence
  Synthetic
aauaaggaaauacaaaaa

SEQ ID NO: 1571 - RNA, 20 nt, Artificial Sequence
  Synthetic
aaaaaaaaaaacaacaaaaa

SEQ ID NO: 1572 - RNA, 19 nt, Artificial Sequence
  Synthetic
aaaaaaaaaacaacaaaaa

SEQ ID NO: 1573 - RNA, 18 nt, Artificial Sequence
  Synthetic
aaaaaaaaacaacaaaaa

SEQ ID NO: 1574 - RNA, 24 nt, Artificial Sequence
  Synthetic
agagucucacuguguugcccaggc

SEQ ID NO: 1575 - RNA, 22 nt, Artificial Sequence
  Synthetic
agucucacuguguugcccaggc

SEQ ID NO: 1576 - RNA, 21 nt, Artificial Sequence
  Synthetic
caaaaaaaaaaacaacaaaaa

SEQ ID NO: 1577 - RNA, 19 nt, Artificial Sequence
  Synthetic
cucacuguguugcccaggc

SEQ ID NO: 1578 - RNA, 23 nt, Artificial Sequence
  Synthetic
uaauaaggaaauacaaaaacugg

SEQ ID NO: 1579 - RNA, 20 nt, Artificial Sequence
  Synthetic
uaaggaaauacaaaaacugg

SEQ ID NO: 1580 - RNA, 23 nt, Artificial Sequence
  Synthetic
uagauaauaaggaaauacaaaaa

SEQ ID NO: 1581 - RNA, 19 nt, Artificial Sequence
  Synthetic
uaauaaggaaauacaaaaa

SEQ ID NO: 1582 - RNA, 24 nt, Artificial Sequence
  Synthetic
uguguugcccaggcuggagugcag

SEQ ID NO: 1583 - RNA, 22 nt, Artificial Sequence
  Synthetic
uguugcccaggcuggagugcag

SEQ ID NO: 1584 - RNA, 20 nt, Artificial Sequence
  Synthetic
uugcccaggcuggagugcag

SEQ ID NO: 1585 - RNA, 19 nt, Artificial Sequence
  Synthetic
ugcccaggcuggagugcag

SEQ ID NO: 1586 - RNA, 24 nt, Artificial Sequence
  Synthetic
uuucaaaaaaaaaaacaacaaaaa

SEQ ID NO: 1587 - RNA, 23 nt, Artificial Sequence
  Synthetic
uucaaaaaaaaaaacaacaaaaa

SEQ ID NO: 1588 - RNA, 22 nt, Artificial Sequence
  Synthetic
ucaaaaaaaaaaacaacaaaaa

SEQ ID NO: 1589 - RNA, 24 nt, Artificial Sequence
  Synthetic
uuuuuguuguuuuuuuuuuugaaa

SEQ ID NO: 1590 - RNA, 23 nt, Artificial Sequence
  Synthetic
uuuuguuguuuuuuuuuuugaaa

SEQ ID NO: 1591 - RNA, 22 nt, Artificial Sequence
  Synthetic
uuuguuguuuuuuuuuuugaaa

SEQ ID NO: 1592 - RNA, 21 nt, Artificial Sequence
  Synthetic
uuguuguuuuuuuuuuugaaa

SEQ ID NO: 1593 - RNA, 20 nt, Artificial Sequence
  Synthetic
uguuguuuuuuuuuuugaaa

SEQ ID NO: 1594 - RNA, 18 nt, Artificial Sequence
  Synthetic
uuguuuuuuuuuuugaaa

SEQ ID NO: 1595 - RNA, 20 nt, Artificial Sequence
  Synthetic
ucucacuguguugcccaggc

SEQ ID NO: 1596 - RNA, 18 nt, Artificial Sequence
  Synthetic
ucacuguguugcccaggc

SEQ ID NO: 1597 - RNA, 21 nt, Artificial Sequence
  Synthetic
acuguuggcuacauccauucc

SEQ ID NO: 1598 - RNA, 24 nt, Artificial Sequence
  Synthetic
aauuuacagagugcauccaugguc

SEQ ID NO: 1599 - RNA, 23 nt, Artificial Sequence
  Synthetic
auuuacagagugcauccaugguc

SEQ ID NO: 1600 - RNA, 19 nt, Artificial Sequence
  Synthetic
acagagugcauccaugguc

SEQ ID NO: 1601 - RNA, 20 nt, Artificial Sequence
  Synthetic
agcauuagaaaguccuaggc

SEQ ID NO: 1602 - RNA, 21 nt, Artificial Sequence
  Synthetic
auggucccuggcuuuuguucc

SEQ ID NO: 1603 - RNA, 19 nt, Artificial Sequence
  Synthetic
auagagacacauucaguaa

SEQ ID NO: 1604 - RNA, 24 nt, Artificial Sequence
  Synthetic
agcucaaaagcuuuugcuggcuca

SEQ ID NO: 1605 - RNA, 19 nt, Artificial Sequence
  Synthetic
aaaagcuuuugcuggcuca

SEQ ID NO: 1606 - RNA, 18 nt, Artificial Sequence
  Synthetic
aaagcuuuugcuggcuca

SEQ ID NO: 1607 - RNA, 24 nt, Artificial Sequence
  Synthetic
aauccauaagccucuauuucugau

SEQ ID NO: 1608 - RNA, 23 nt, Artificial Sequence
  Synthetic
auccauaagccucuauuucugau

SEQ ID NO: 1609 - RNA, 19 nt, Artificial Sequence
  Synthetic
auaagccucuauuucugau

SEQ ID NO: 1610 - RNA, 23 nt, Artificial Sequence
  Synthetic
agcuaaaucaugcaagugaccua

SEQ ID NO: 1611 - RNA, 19 nt, Artificial Sequence
  Synthetic
aaaucaugcaagugaccua

SEQ ID NO: 1612 - RNA, 18 nt, Artificial Sequence
  Synthetic
aaucaugcaagugaccua

SEQ ID NO: 1613 - RNA, 23 nt, Artificial Sequence
  Synthetic
aaaccucuuuuaaccagacaucu

SEQ ID NO: 1614 - RNA, 22 nt, Artificial Sequence
  Synthetic
aaccucuuuuaaccagacaucu

SEQ ID NO: 1615 - RNA, 21 nt, Artificial Sequence
  Synthetic
accucuuuuaaccagacaucu

SEQ ID NO: 1616 - RNA, 24 nt, Artificial Sequence
  Synthetic
aguuuguucuggguacagggguaa

SEQ ID NO: 1617 - RNA, 24 nt, Artificial Sequence
  Synthetic
augacucauaauuuaguaggaauc

SEQ ID NO: 1618 - RNA, 21 nt, Artificial Sequence
  Synthetic
acucauaauuuaguaggaauc

SEQ ID NO: 1619 - RNA, 21 nt, Artificial Sequence
  Synthetic
aauggauguagccaacaguag

SEQ ID NO: 1620 - RNA, 20 nt, Artificial Sequence
  Synthetic
auggauguagccaacaguag

SEQ ID NO: 1621 - RNA, 24 nt, Artificial Sequence
  Synthetic
aucaccucucuuuggcaaaagcag

SEQ ID NO: 1622 - RNA, 21 nt, Artificial Sequence
  Synthetic
accucucuuuggcaaaagcag

SEQ ID NO: 1623 - RNA, 23 nt, Artificial Sequence
  Synthetic
agguagaauauuguaaucaaagg

SEQ ID NO: 1624 - RNA, 19 nt, Artificial Sequence
  Synthetic
agaauauuguaaucaaagg

SEQ ID NO: 1625 - RNA, 21 nt, Artificial Sequence
  Synthetic
aaggaacaaaagccagggacc

SEQ ID NO: 1626 - RNA, 20 nt, Artificial Sequence
  Synthetic
aggaacaaaagccagggacc

SEQ ID NO: 1627 - RNA, 24 nt, Artificial Sequence
  Synthetic
acauccauuccaaggaacaaaagc

SEQ ID NO: 1628 - RNA, 22 nt, Artificial Sequence
  Synthetic
auccauuccaaggaacaaaagc

SEQ ID NO: 1629 - RNA, 18 nt, Artificial Sequence
  Synthetic
auuccaaggaacaaaagc

SEQ ID NO: 1630 - RNA, 24 nt, Artificial Sequence
  Synthetic
agaauuagaucuuauucuacuccu

SEQ ID NO: 1631 - RNA, 22 nt, Artificial Sequence
  Synthetic
aauuagaucuuauucuacuccu

SEQ ID NO: 1632 - RNA, 21 nt, Artificial Sequence
  Synthetic
auuagaucuuauucuacuccu

SEQ ID NO: 1633 - RNA, 18 nt, Artificial Sequence
  Synthetic
agaucuuauucuacuccu

SEQ ID NO: 1634 - RNA, 19 nt, Artificial Sequence
  Synthetic
auuuguucaucuuccucau

SEQ ID NO: 1635 - RNA, 23 nt, Artificial Sequence
  Synthetic
agaggugauuauguuacuuuuua

SEQ ID NO: 1636 - RNA, 21 nt, Artificial Sequence
  Synthetic
aggugauuauguuacuuuuua

SEQ ID NO: 1637 - RNA, 24 nt, Artificial Sequence
  Synthetic
aaccucuuuuaaccagacaucuaa

SEQ ID NO: 1638 - RNA, 23 nt, Artificial Sequence
  Synthetic
accucuuuuaaccagacaucuaa

SEQ ID NO: 1639 - RNA, 22 nt, Artificial Sequence
  Synthetic
auaaacaugacucauaauuuag

SEQ ID NO: 1640 - RNA, 20 nt, Artificial Sequence
  Synthetic
aaacaugacucauaauuuag

SEQ ID NO: 1641 - RNA, 19 nt, Artificial Sequence
  Synthetic
aacaugacucauaauuuag

SEQ ID NO: 1642 - RNA, 18 nt, Artificial Sequence
  Synthetic
acaugacucauaauuuag

SEQ ID NO: 1643 - RNA, 24 nt, Artificial Sequence
  Synthetic
acagguagaauauuguaaucaaag

SEQ ID NO: 1644 - RNA, 22 nt, Artificial Sequence
  Synthetic
agguagaauauuguaaucaaag

SEQ ID NO: 1645 - RNA, 18 nt, Artificial Sequence
  Synthetic
agaauauuguaaucaaag

SEQ ID NO: 1646 - RNA, 24 nt, Artificial Sequence
  Synthetic
auaguuuguucuggguacaggggu

SEQ ID NO: 1647 - RNA, 22 nt, Artificial Sequence
  Synthetic
aguuuguucuggguacaggggu

SEQ ID NO: 1648 - RNA, 23 nt, Artificial Sequence
  Synthetic
agacaucuaagagaaaaaggagc

SEQ ID NO: 1649 - RNA, 21 nt, Artificial Sequence
  Synthetic
acaucuaagagaaaaaggagc

SEQ ID NO: 1650 - RNA, 19 nt, Artificial Sequence
  Synthetic
aucuaagagaaaaaggagc

SEQ ID NO: 1651 - RNA, 20 nt, Artificial Sequence
  Synthetic
agaggauaggacagaggaca

SEQ ID NO: 1652 - RNA, 18 nt, Artificial Sequence
  Synthetic
aggauaggacagaggaca

SEQ ID NO: 1653 - RNA, 22 nt, Artificial Sequence
  Synthetic
aggaaagaugaaaaauacucuu

SEQ ID NO: 1654 - RNA, 19 nt, Artificial Sequence
  Synthetic
aaagaugaaaaauacucuu

SEQ ID NO: 1655 - RNA, 18 nt, Artificial Sequence
  Synthetic
aagaugaaaaauacucuu

SEQ ID NO: 1656 - RNA, 23 nt, Artificial Sequence
  Synthetic
aggaaagaugaaaaauacucuuu

SEQ ID NO: 1657 - RNA, 20 nt, Artificial Sequence
  Synthetic
aaagaugaaaaauacucuuu

SEQ ID NO: 1658 - RNA, 19 nt, Artificial Sequence
  Synthetic
aagaugaaaaauacucuuu

SEQ ID NO: 1659 - RNA, 18 nt, Artificial Sequence
  Synthetic
agaugaaaaauacucuuu

SEQ ID NO: 1660 - RNA, 21 nt, Artificial Sequence
  Synthetic
aggaaagaugaaaaauacucu

SEQ ID NO: 1661 - RNA, 18 nt, Artificial Sequence
  Synthetic
aaagaugaaaaauacucu

SEQ ID NO: 1662 - RNA, 22 nt, Artificial Sequence
  Synthetic
auaggacagaggacauggagaa

SEQ ID NO: 1663 - RNA, 20 nt, Artificial Sequence
  Synthetic
aggacagaggacauggagaa

SEQ ID NO: 1664 - RNA, 24 nt, Artificial Sequence
  Synthetic
aggauaggacagaggacauggaga

SEQ ID NO: 1665 - RNA, 21 nt, Artificial Sequence
  Synthetic
auaggacagaggacauggaga

SEQ ID NO: 1666 - RNA, 19 nt, Artificial Sequence
  Synthetic
aggacagaggacauggaga

SEQ ID NO: 1667 - RNA, 23 nt, Artificial Sequence
  Synthetic
aaggaacaaaagccagggaccau

SEQ ID NO: 1668 - RNA, 22 nt, Artificial Sequence
  Synthetic
aggaacaaaagccagggaccau

SEQ ID NO: 1669 - RNA, 19 nt, Artificial Sequence
  Synthetic
aacaaaagccagggaccau

SEQ ID NO: 1670 - RNA, 18 nt, Artificial Sequence
  Synthetic
acaaaagccagggaccau

SEQ ID NO: 1671 - RNA, 24 nt, Artificial Sequence
  Synthetic
acauuuauucuacaauaaaaaaug

SEQ ID NO: 1672 - RNA, 22 nt, Artificial Sequence
  Synthetic
auuuauucuacaauaaaaaaug

SEQ ID NO: 1673 - RNA, 18 nt, Artificial Sequence
  Synthetic
auucuacaauaaaaaaug

SEQ ID NO: 1674 - RNA, 24 nt, Artificial Sequence
  Synthetic
auuguguguguguguguguguuau

SEQ ID NO: 1675 - RNA, 23 nt, Artificial Sequence
  Synthetic
cuacuguuggcuacauccauucc

SEQ ID NO: 1676 - RNA, 20 nt, Artificial Sequence
  Synthetic
cuguuggcuacauccauucc

SEQ ID NO: 1677 - RNA, 18 nt, Artificial Sequence
  Synthetic
cagagugcauccaugguc

SEQ ID NO: 1678 - RNA, 24 nt, Artificial Sequence
  Synthetic
cuccagcauuagaaaguccuaggc

SEQ ID NO: 1679 - RNA, 22 nt, Artificial Sequence
  Synthetic
ccagcauuagaaaguccuaggc

SEQ ID NO: 1680 - RNA, 21 nt, Artificial Sequence
  Synthetic
cagcauuagaaaguccuaggc

SEQ ID NO: 1681 - RNA, 18 nt, Artificial Sequence
  Synthetic
cauuagaaaguccuaggc

SEQ ID NO: 1682 - RNA, 24 nt, Artificial Sequence
  Synthetic
cccauggucccuggcuuuuguucc

SEQ ID NO: 1683 - RNA, 23 nt, Artificial Sequence
  Synthetic
ccauggucccuggcuuuuguucc

SEQ ID NO: 1684 - RNA, 22 nt, Artificial Sequence
  Synthetic
cauggucccuggcuuuuguucc

SEQ ID NO: 1685 - RNA, 22 nt, Artificial Sequence
  Synthetic
cucauagagacacauucaguaa

SEQ ID NO: 1686 - RNA, 20 nt, Artificial Sequence
  Synthetic
cauagagacacauucaguaa

SEQ ID NO: 1687 - RNA, 22 nt, Artificial Sequence
  Synthetic
cucaaaagcuuuugcuggcuca

SEQ ID NO: 1688 - RNA, 20 nt, Artificial Sequence
  Synthetic
caaaagcuuuugcuggcuca

SEQ ID NO: 1689 - RNA, 21 nt, Artificial Sequence
  Synthetic
ccauaagccucuauuucugau

SEQ ID NO: 1690 - RNA, 20 nt, Artificial Sequence
  Synthetic
cauaagccucuauuucugau

SEQ ID NO: 1691 - RNA, 24 nt, Artificial Sequence
  Synthetic
cagcuaaaucaugcaagugaccua

SEQ ID NO: 1692 - RNA, 21 nt, Artificial Sequence
  Synthetic
cuaaaucaugcaagugaccua

SEQ ID NO: 1693 - RNA, 24 nt, Artificial Sequence
  Synthetic
caaaccucuuuuaaccagacaucu

SEQ ID NO: 1694 - RNA, 20 nt, Artificial Sequence
  Synthetic
ccucuuuuaaccagacaucu

SEQ ID NO: 1695 - RNA, 19 nt, Artificial Sequence
  Synthetic
cucuuuuaaccagacaucu

SEQ ID NO: 1696 - RNA, 20 nt, Artificial Sequence
  Synthetic
cucauaauuuaguaggaauc

SEQ ID NO: 1697 - RNA, 18 nt, Artificial Sequence
  Synthetic
cauaauuuaguaggaauc

SEQ ID NO: 1698 - RNA, 22 nt, Artificial Sequence
  Synthetic
caccucucuuuggcaaaagcag

SEQ ID NO: 1699 - RNA, 20 nt, Artificial Sequence
  Synthetic
ccucucuuuggcaaaagcag

SEQ ID NO: 1700 - RNA, 19 nt, Artificial Sequence
  Synthetic
cucucuuuggcaaaagcag

SEQ ID NO: 1701 - RNA, 24 nt, Artificial Sequence
  Synthetic
cagguagaauauuguaaucaaagg

SEQ ID NO: 1702 - RNA, 23 nt, Artificial Sequence
  Synthetic
ccaaggaacaaaagccagggacc

SEQ ID NO: 1703 - RNA, 22 nt, Artificial Sequence
  Synthetic
caaggaacaaaagccagggacc

SEQ ID NO: 1704 - RNA, 23 nt, Artificial Sequence
  Synthetic
cauccauuccaaggaacaaaagc

SEQ ID NO: 1705 - RNA, 20 nt, Artificial Sequence
  Synthetic
ccauuccaaggaacaaaagc

SEQ ID NO: 1706 - RNA, 19 nt, Artificial Sequence
  Synthetic
cauuccaaggaacaaaagc

SEQ ID NO: 1707 - RNA, 24 nt, Artificial Sequence
  Synthetic
cucuugccuaggacuuucuaaugc

SEQ ID NO: 1708 - RNA, 22 nt, Artificial Sequence
  Synthetic
cuugccuaggacuuucuaaugc

SEQ ID NO: 1709 - RNA, 18 nt, Artificial Sequence
  Synthetic
ccuaggacuuucuaaugc

SEQ ID NO: 1710 - RNA, 23 nt, Artificial Sequence
  Synthetic
ccugauuuguucaucuuccucau

SEQ ID NO: 1711 - RNA, 22 nt, Artificial Sequence
  Synthetic
cugauuuguucaucuuccucau

SEQ ID NO: 1712 - RNA, 22 nt, Artificial Sequence
  Synthetic
ccucuuuuaaccagacaucuaa

SEQ ID NO: 1713 - RNA, 21 nt, Artificial Sequence
  Synthetic
cucuuuuaaccagacaucuaa

SEQ ID NO: 1714 - RNA, 19 nt, Artificial Sequence
  Synthetic
cuuuuaaccagacaucuaa

SEQ ID NO: 1715 - RNA, 24 nt, Artificial Sequence
  Synthetic
ccucuguccuauccucuccagcau

SEQ ID NO: 1716 - RNA, 23 nt, Artificial Sequence
  Synthetic
cucuguccuauccucuccagcau

SEQ ID NO: 1717 - RNA, 21 nt, Artificial Sequence
  Synthetic
cuguccuauccucuccagcau

SEQ ID NO: 1718 - RNA, 23 nt, Artificial Sequence
  Synthetic
cagguagaauauuguaaucaaag

SEQ ID NO: 1719 - RNA, 20 nt, Artificial Sequence
  Synthetic
cuggguacagggguaagaga

SEQ ID NO: 1720 - RNA, 19 nt, Artificial Sequence
  Synthetic
cuuucugcugcuuuugcca

SEQ ID NO: 1721 - RNA, 24 nt, Artificial Sequence
  Synthetic
cagacaucuaagagaaaaaggagc

SEQ ID NO: 1722 - RNA, 20 nt, Artificial Sequence
  Synthetic
caucuaagagaaaaaggagc

SEQ ID NO: 1723 - RNA, 24 nt, Artificial Sequence
  Synthetic
cuggagaggauaggacagaggaca

SEQ ID NO: 1724 - RNA, 24 nt, Artificial Sequence
  Synthetic
caaggaacaaaagccagggaccau

SEQ ID NO: 1725 - RNA, 23 nt, Artificial Sequence
  Synthetic
cauuuauucuacaauaaaaaaug

SEQ ID NO: 1726 - RNA, 24 nt, Artificial Sequence
  Synthetic
gcuacuguuggcuacauccauucc

SEQ ID NO: 1727 - RNA, 18 nt, Artificial Sequence
  Synthetic
guuggcuacauccauucc

SEQ ID NO: 1728 - RNA, 19 nt, Artificial Sequence
  Synthetic
gcauuagaaaguccuaggc

SEQ ID NO: 1729 - RNA, 19 nt, Artificial Sequence
  Synthetic
ggucccuggcuuuuguucc

SEQ ID NO: 1730 - RNA, 18 nt, Artificial Sequence
  Synthetic
gucccuggcuuuuguucc

SEQ ID NO: 1731 - RNA, 24 nt, Artificial Sequence
  Synthetic
ggcucauagagacacauucaguaa

SEQ ID NO: 1732 - RNA, 23 nt, Artificial Sequence
  Synthetic
gcucauagagacacauucaguaa

SEQ ID NO: 1733 - RNA, 23 nt, Artificial Sequence
  Synthetic
gcucaaaagcuuuugcuggcuca

SEQ ID NO: 1734 - RNA, 22 nt, Artificial Sequence
  Synthetic
gcuaaaucaugcaagugaccua

SEQ ID NO: 1735 - RNA, 23 nt, Artificial Sequence
  Synthetic
guuuguucuggguacagggguaa

SEQ ID NO: 1736 - RNA, 19 nt, Artificial Sequence
  Synthetic
guucuggguacagggguaa

SEQ ID NO: 1737 - RNA, 22 nt, Artificial Sequence
  Synthetic
gacucauaauuuaguaggaauc

SEQ ID NO: 1738 - RNA, 23 nt, Artificial Sequence
  Synthetic
ggaauggauguagccaacaguag

SEQ ID NO: 1739 - RNA, 22 nt, Artificial Sequence
  Synthetic
gaauggauguagccaacaguag

SEQ ID NO: 1740 - RNA, 18 nt, Artificial Sequence
  Synthetic
ggauguagccaacaguag

SEQ ID NO: 1741 - RNA, 22 nt, Artificial Sequence
  Synthetic
gguagaauauuguaaucaaagg

SEQ ID NO: 1742 - RNA, 21 nt, Artificial Sequence
  Synthetic
guagaauauuguaaucaaagg

SEQ ID NO: 1743 - RNA, 18 nt, Artificial Sequence
  Synthetic
gaauauuguaaucaaagg

SEQ ID NO: 1744 - RNA, 19 nt, Artificial Sequence
  Synthetic
ggaacaaaagccagggacc

SEQ ID NO: 1745 - RNA, 18 nt, Artificial Sequence
  Synthetic
gaacaaaagccagggacc

SEQ ID NO: 1746 - RNA, 23 nt, Artificial Sequence
  Synthetic
gaauuagaucuuauucuacuccu

SEQ ID NO: 1747 - RNA, 19 nt, Artificial Sequence
  Synthetic
gccuaggacuuucuaaugc

SEQ ID NO: 1748 - RNA, 20 nt, Artificial Sequence
  Synthetic
gauuuguucaucuuccucau

SEQ ID NO: 1749 - RNA, 24 nt, Artificial Sequence
  Synthetic
gagaggugauuauguuacuuuuua

SEQ ID NO: 1750 - RNA, 22 nt, Artificial Sequence
  Synthetic
gaggugauuauguuacuuuuua

SEQ ID NO: 1751 - RNA, 20 nt, Artificial Sequence
  Synthetic
ggugauuauguuacuuuuua

SEQ ID NO: 1752 - RNA, 19 nt, Artificial Sequence
  Synthetic
gugauuauguuacuuuuua

SEQ ID NO: 1753 - RNA, 19 nt, Artificial Sequence
  Synthetic
guccuauccucuccagcau

SEQ ID NO: 1754 - RNA, 23 nt, Artificial Sequence
  Synthetic
gauaaacaugacucauaauuuag

SEQ ID NO: 1755 - RNA, 21 nt, Artificial Sequence
  Synthetic
gguagaauauuguaaucaaag

SEQ ID NO: 1756 - RNA, 20 nt, Artificial Sequence
  Synthetic
guagaauauuguaaucaaag

SEQ ID NO: 1757 - RNA, 23 nt, Artificial Sequence
  Synthetic
guucuggguacagggguaagaga

SEQ ID NO: 1758 - RNA, 18 nt, Artificial Sequence
  Synthetic
ggguacagggguaagaga

SEQ ID NO: 1759 - RNA, 21 nt, Artificial Sequence
  Synthetic
guuuguucuggguacaggggu

SEQ ID NO: 1760 - RNA, 24 nt, Artificial Sequence
  Synthetic
guuugcuuucugcugcuuuugcca

SEQ ID NO: 1761 - RNA, 20 nt, Artificial Sequence
  Synthetic
gcuuucugcugcuuuugcca

SEQ ID NO: 1762 - RNA, 22 nt, Artificial Sequence
  Synthetic
gacaucuaagagaaaaaggagc

SEQ ID NO: 1763 - RNA, 22 nt, Artificial Sequence
  Synthetic
ggagaggauaggacagaggaca

SEQ ID NO: 1764 - RNA, 21 nt, Artificial Sequence
  Synthetic
gagaggauaggacagaggaca

SEQ ID NO: 1765 - RNA, 19 nt, Artificial Sequence
  Synthetic
gaggauaggacagaggaca

SEQ ID NO: 1766 - RNA, 21 nt, Artificial Sequence
  Synthetic
ggaaagaugaaaaauacucuu

SEQ ID NO: 1767 - RNA, 22 nt, Artificial Sequence
  Synthetic
ggaaagaugaaaaauacucuuu

SEQ ID NO: 1768 - RNA, 21 nt, Artificial Sequence
  Synthetic
gaaagaugaaaaauacucuuu

SEQ ID NO: 1769 - RNA, 20 nt, Artificial Sequence
  Synthetic
ggaaagaugaaaaauacucu

SEQ ID NO: 1770 - RNA, 19 nt, Artificial Sequence
  Synthetic
gaaagaugaaaaauacucu

SEQ ID NO: 1771 - RNA, 24 nt, Artificial Sequence
  Synthetic
ggauaggacagaggacauggagaa

SEQ ID NO: 1772 - RNA, 23 nt, Artificial Sequence
  Synthetic
gauaggacagaggacauggagaa

SEQ ID NO: 1773 - RNA, 19 nt, Artificial Sequence
  Synthetic
ggacagaggacauggagaa

SEQ ID NO: 1774 - RNA, 18 nt, Artificial Sequence
  Synthetic
gacagaggacauggagaa

SEQ ID NO: 1775 - RNA, 23 nt, Artificial Sequence
  Synthetic
ggauaggacagaggacauggaga

SEQ ID NO: 1776 - RNA, 22 nt, Artificial Sequence
  Synthetic
gauaggacagaggacauggaga

SEQ ID NO: 1777 - RNA, 18 nt, Artificial Sequence
  Synthetic
ggacagaggacauggaga

SEQ ID NO: 1778 - RNA, 21 nt, Artificial Sequence
  Synthetic
ggaacaaaagccagggaccau

SEQ ID NO: 1779 - RNA, 21 nt, Artificial Sequence
  Synthetic
guguguguguguguguguuau

SEQ ID NO: 1780 - RNA, 19 nt, Artificial Sequence
  Synthetic
guguguguguguguguuau

SEQ ID NO: 1781 - RNA, 22 nt, Artificial Sequence
  Synthetic
guguguguguguguguguuaug

SEQ ID NO: 1782 - RNA, 20 nt, Artificial Sequence
  Synthetic
guguguguguguguguuaug

SEQ ID NO: 1783 - RNA, 18 nt, Artificial Sequence
  Synthetic
guguguguguguguuaug

SEQ ID NO: 1784 - RNA, 22 nt, Artificial Sequence
  Synthetic
uacuguuggcuacauccauucc

SEQ ID NO: 1785 - RNA, 19 nt, Artificial Sequence
  Synthetic
uguuggcuacauccauucc

SEQ ID NO: 1786 - RNA, 22 nt, Artificial Sequence
  Synthetic
uuuacagagugcauccaugguc

SEQ ID NO: 1787 - RNA, 21 nt, Artificial Sequence
  Synthetic
uuacagagugcauccaugguc

SEQ ID NO: 1788 - RNA, 20 nt, Artificial Sequence
  Synthetic
uacagagugcauccaugguc

SEQ ID NO: 1789 - RNA, 23 nt, Artificial Sequence
  Synthetic
uccagcauuagaaaguccuaggc

SEQ ID NO: 1790 - RNA, 20 nt, Artificial Sequence
  Synthetic
uggucccuggcuuuuguucc

SEQ ID NO: 1791 - RNA, 21 nt, Artificial Sequence
  Synthetic
ucauagagacacauucaguaa

SEQ ID NO: 1792 - RNA, 18 nt, Artificial Sequence
  Synthetic
uagagacacauucaguaa

SEQ ID NO: 1793 - RNA, 21 nt, Artificial Sequence
  Synthetic
ucaaaagcuuuugcuggcuca

SEQ ID NO: 1794 - RNA, 22 nt, Artificial Sequence
  Synthetic
uccauaagccucuauuucugau

SEQ ID NO: 1795 - RNA, 18 nt, Artificial Sequence
  Synthetic
uaagccucuauuucugau

SEQ ID NO: 1796 - RNA, 18 nt, Artificial Sequence
  Synthetic
ucuuuuaaccagacaucu

SEQ ID NO: 1797 - RNA, 22 nt, Artificial Sequence
  Synthetic
uuuguucuggguacagggguaa

SEQ ID NO: 1798 - RNA, 21 nt, Artificial Sequence
  Synthetic
uuguucuggguacagggguaa

SEQ ID NO: 1799 - RNA, 20 nt, Artificial Sequence
  Synthetic
uguucuggguacagggguaa

SEQ ID NO: 1800 - RNA, 18 nt, Artificial Sequence
  Synthetic
uucuggguacagggguaa

SEQ ID NO: 1801 - RNA, 23 nt, Artificial Sequence
  Synthetic
ugacucauaauuuaguaggaauc

SEQ ID NO: 1802 - RNA, 19 nt, Artificial Sequence
  Synthetic
ucauaauuuaguaggaauc

SEQ ID NO: 1803 - RNA, 24 nt, Artificial Sequence
  Synthetic
uggaauggauguagccaacaguag

SEQ ID NO: 1804 - RNA, 19 nt, Artificial Sequence
  Synthetic
uggauguagccaacaguag

SEQ ID NO: 1805 - RNA, 23 nt, Artificial Sequence
  Synthetic
ucaccucucuuuggcaaaagcag

SEQ ID NO: 1806 - RNA, 18 nt, Artificial Sequence
  Synthetic
ucucuuuggcaaaagcag

SEQ ID NO: 1807 - RNA, 20 nt, Artificial Sequence
  Synthetic
uagaauauuguaaucaaagg

SEQ ID NO: 1808 - RNA, 24 nt, Artificial Sequence
  Synthetic
uccaaggaacaaaagccagggacc

SEQ ID NO: 1809 - RNA, 21 nt, Artificial Sequence
  Synthetic
uccauuccaaggaacaaaagc

SEQ ID NO: 1810 - RNA, 20 nt, Artificial Sequence
  Synthetic
uuagaucuuauucuacuccu

SEQ ID NO: 1811 - RNA, 19 nt, Artificial Sequence
  Synthetic
uagaucuuauucuacuccu

SEQ ID NO: 1812 - RNA, 23 nt, Artificial Sequence
  Synthetic
ucuugccuaggacuuucuaaugc

SEQ ID NO: 1813 - RNA, 21 nt, Artificial Sequence
  Synthetic
uugccuaggacuuucuaaugc

SEQ ID NO: 1814 - RNA, 24 nt, Artificial Sequence
  Synthetic
uccugauuuguucaucuuccucau

SEQ ID NO: 1815 - RNA, 21 nt, Artificial Sequence
  Synthetic
ugauuuguucaucuuccucau

SEQ ID NO: 1816 - RNA, 18 nt, Artificial Sequence
  Synthetic
uuuguucaucuuccucau

SEQ ID NO: 1817 - RNA, 18 nt, Artificial Sequence
  Synthetic
ugauuauguuacuuuuua

SEQ ID NO: 1818 - RNA, 20 nt, Artificial Sequence
  Synthetic
ucuuuuaaccagacaucuaa

SEQ ID NO: 1819 - RNA, 18 nt, Artificial Sequence
  Synthetic
uuuuaaccagacaucuaa

SEQ ID NO: 1820 - RNA, 22 nt, Artificial Sequence
  Synthetic
ucuguccuauccucuccagcau

SEQ ID NO: 1821 - RNA, 20 nt, Artificial Sequence
  Synthetic
uguccuauccucuccagcau

SEQ ID NO: 1822 - RNA, 18 nt, Artificial Sequence
  Synthetic
uccuauccucuccagcau

SEQ ID NO: 1823 - RNA, 24 nt, Artificial Sequence
  Synthetic
ugauaaacaugacucauaauuuag

SEQ ID NO: 1824 - RNA, 21 nt, Artificial Sequence
  Synthetic
uaaacaugacucauaauuuag

SEQ ID NO: 1825 - RNA, 19 nt, Artificial Sequence
  Synthetic
uagaauauuguaaucaaag

SEQ ID NO: 1826 - RNA, 24 nt, Artificial Sequence
  Synthetic
uguucuggguacagggguaagaga

SEQ ID NO: 1827 - RNA, 22 nt, Artificial Sequence
  Synthetic
uucuggguacagggguaagaga

SEQ ID NO: 1828 - RNA, 21 nt, Artificial Sequence
  Synthetic
ucuggguacagggguaagaga

SEQ ID NO: 1829 - RNA, 19 nt, Artificial Sequence
  Synthetic
uggguacagggguaagaga

SEQ ID NO: 1830 - RNA, 23 nt, Artificial Sequence
  Synthetic
uaguuuguucuggguacaggggu

SEQ ID NO: 1831 - RNA, 20 nt, Artificial Sequence
  Synthetic
uuuguucuggguacaggggu

SEQ ID NO: 1832 - RNA, 19 nt, Artificial Sequence
  Synthetic
uuguucuggguacaggggu

SEQ ID NO: 1833 - RNA, 18 nt, Artificial Sequence
  Synthetic
uguucuggguacaggggu

SEQ ID NO: 1834 - RNA, 23 nt, Artificial Sequence
  Synthetic
uuugcuuucugcugcuuuugcca

SEQ ID NO: 1835 - RNA, 22 nt, Artificial Sequence
  Synthetic
uugcuuucugcugcuuuugcca

SEQ ID NO: 1836 - RNA, 21 nt, Artificial Sequence
  Synthetic
ugcuuucugcugcuuuugcca

SEQ ID NO: 1837 - RNA, 18 nt, Artificial Sequence
  Synthetic
uuucugcugcuuuugcca

SEQ ID NO: 1838 - RNA, 18 nt, Artificial Sequence
  Synthetic
ucuaagagaaaaaggagc

SEQ ID NO: 1839 - RNA, 23 nt, Artificial Sequence
  Synthetic
uggagaggauaggacagaggaca

SEQ ID NO: 1840 - RNA, 24 nt, Artificial Sequence
  Synthetic
uuaggaaagaugaaaaauacucuu

SEQ ID NO: 1841 - RNA, 23 nt, Artificial Sequence
  Synthetic
uaggaaagaugaaaaauacucuu

SEQ ID NO: 1842 - RNA, 24 nt, Artificial Sequence
  Synthetic
uaggaaagaugaaaaauacucuuu

SEQ ID NO: 1843 - RNA, 24 nt, Artificial Sequence
  Synthetic
uuuaggaaagaugaaaaauacucu

SEQ ID NO: 1844 - RNA, 23 nt, Artificial Sequence
  Synthetic
uuaggaaagaugaaaaauacucu

SEQ ID NO: 1845 - RNA, 22 nt, Artificial Sequence
  Synthetic
uaggaaagaugaaaaauacucu

SEQ ID NO: 1846 - RNA, 21 nt, Artificial Sequence
  Synthetic
uaggacagaggacauggagaa

SEQ ID NO: 1847 - RNA, 20 nt, Artificial Sequence
  Synthetic
uaggacagaggacauggaga

SEQ ID NO: 1848 - RNA, 21 nt, Artificial Sequence
  Synthetic
uuuauucuacaauaaaaaaug

SEQ ID NO: 1849 - RNA, 20 nt, Artificial Sequence
  Synthetic
uuauucuacaauaaaaaaug

SEQ ID NO: 1850 - RNA, 19 nt, Artificial Sequence
  Synthetic
uauucuacaauaaaaaaug

SEQ ID NO: 1851 - RNA, 23 nt, Artificial Sequence
  Synthetic
uuguguguguguguguguguuau

SEQ ID NO: 1852 - RNA, 22 nt, Artificial Sequence
  Synthetic
uguguguguguguguguguuau

SEQ ID NO: 1853 - RNA, 20 nt, Artificial Sequence
  Synthetic
uguguguguguguguguuau

SEQ ID NO: 1854 - RNA, 18 nt, Artificial Sequence
  Synthetic
uguguguguguguguuau

SEQ ID NO: 1855 - RNA, 24 nt, Artificial Sequence
  Synthetic
uuguguguguguguguguguuaug

SEQ ID NO: 1856 - RNA, 23 nt, Artificial Sequence
  Synthetic
uguguguguguguguguguuaug

SEQ ID NO: 1857 - RNA, 21 nt, Artificial Sequence
  Synthetic
uguguguguguguguguuaug

SEQ ID NO: 1858 - RNA, 19 nt, Artificial Sequence
  Synthetic
uguguguguguguguuaug

SEQ ID NO: 1859 - RNA, 22 nt, Artificial Sequence
  Synthetic
acuguuggcuacauccauucca

SEQ ID NO: 1860 - RNA, 24 nt, Artificial Sequence
  Synthetic
auuauccacaagaugucucuugcc

SEQ ID NO: 1861 - RNA, 21 nt, Artificial Sequence
  Synthetic
auccacaagaugucucuugcc

SEQ ID NO: 1862 - RNA, 18 nt, Artificial Sequence
  Synthetic
augagccagcaaaagcuu

SEQ ID NO: 1863 - RNA, 23 nt, Artificial Sequence
  Synthetic
acagagugcauccaugguccagg

SEQ ID NO: 1864 - RNA, 21 nt, Artificial Sequence
  Synthetic
agagugcauccaugguccagg

SEQ ID NO: 1865 - RNA, 19 nt, Artificial Sequence
  Synthetic
agugcauccaugguccagg

SEQ ID NO: 1866 - RNA, 23 nt, Artificial Sequence
  Synthetic
agcugaaauauuaagggcucuuc

SEQ ID NO: 1867 - RNA, 18 nt, Artificial Sequence
  Synthetic
aaauauuaagggcucuuc

SEQ ID NO: 1868 - RNA, 23 nt, Artificial Sequence
  Synthetic
aacucuauaccuuuuacugagga

SEQ ID NO: 1869 - RNA, 22 nt, Artificial Sequence
  Synthetic
acucuauaccuuuuacugagga

SEQ ID NO: 1870 - RNA, 23 nt, Artificial Sequence
  Synthetic
acuugaacucuauaccuuuuacu

SEQ ID NO: 1871 - RNA, 18 nt, Artificial Sequence
  Synthetic
aacucuauaccuuuuacu

SEQ ID NO: 1872 - RNA, 22 nt, Artificial Sequence
  Synthetic
aguaggaauccugaaagcuacu

SEQ ID NO: 1873 - RNA, 19 nt, Artificial Sequence
  Synthetic
aggaauccugaaagcuacu

SEQ ID NO: 1874 - RNA, 22 nt, Artificial Sequence
  Synthetic
agccaacaguagcugaaauauu

SEQ ID NO: 1875 - RNA, 18 nt, Artificial Sequence
  Synthetic
aacaguagcugaaauauu

SEQ ID NO: 1876 - RNA, 23 nt, Artificial Sequence
  Synthetic
auccauuccaaggaacaaaagcc

SEQ ID NO: 1877 - RNA, 19 nt, Artificial Sequence
  Synthetic
auuccaaggaacaaaagcc

SEQ ID NO: 1878 - RNA, 24 nt, Artificial Sequence
  Synthetic
aucccuuucucuuaccccuguacc

SEQ ID NO: 1879 - RNA, 24 nt, Artificial Sequence
  Synthetic
aggacuuucuaaugcuggagagga

SEQ ID NO: 1880 - RNA, 21 nt, Artificial Sequence
  Synthetic
acuuucuaaugcuggagagga

SEQ ID NO: 1881 - RNA, 21 nt, Artificial Sequence
  Synthetic
aaugcuggagaggauaggaca

SEQ ID NO: 1882 - RNA, 20 nt, Artificial Sequence
  Synthetic
augcuggagaggauaggaca

SEQ ID NO: 1883 - RNA, 23 nt, Artificial Sequence
  Synthetic
aucauaaguuacaaucugugaau

SEQ ID NO: 1884 - RNA, 20 nt, Artificial Sequence
  Synthetic
auaaguuacaaucugugaau

SEQ ID NO: 1885 - RNA, 18 nt, Artificial Sequence
  Synthetic
aaguuacaaucugugaau

SEQ ID NO: 1886 - RNA, 21 nt, Artificial Sequence
  Synthetic
aaccagacaucuaagagaaaa

SEQ ID NO: 1887 - RNA, 20 nt, Artificial Sequence
  Synthetic
accagacaucuaagagaaaa

SEQ ID NO: 1888 - RNA, 24 nt, Artificial Sequence
  Synthetic
aagccucuauuucugaugaggaag

SEQ ID NO: 1889 - RNA, 23 nt, Artificial Sequence
  Synthetic
agccucuauuucugaugaggaag

SEQ ID NO: 1890 - RNA, 20 nt, Artificial Sequence
  Synthetic
augaggaagaugaacaaauc

SEQ ID NO: 1891 - RNA, 19 nt, Artificial Sequence
  Synthetic
auuuacugaaugugucucu

SEQ ID NO: 1892 - RNA, 19 nt, Artificial Sequence
  Synthetic
acagggguaagagaaaggg

SEQ ID NO: 1893 - RNA, 24 nt, Artificial Sequence
  Synthetic
cuacuguuggcuacauccauucca

SEQ ID NO: 1894 - RNA, 21 nt, Artificial Sequence
  Synthetic
cuguuggcuacauccauucca

SEQ ID NO: 1895 - RNA, 19 nt, Artificial Sequence
  Synthetic
ccacaagaugucucuugcc

SEQ ID NO: 1896 - RNA, 18 nt, Artificial Sequence
  Synthetic
cacaagaugucucuugcc

SEQ ID NO: 1897 - RNA, 24 nt, Artificial Sequence
  Synthetic
ccuuuguaguuaucuuacagccac

SEQ ID NO: 1898 - RNA, 23 nt, Artificial Sequence
  Synthetic
cuuuguaguuaucuuacagccac

SEQ ID NO: 1899 - RNA, 22 nt, Artificial Sequence
  Synthetic
cucuaugagccagcaaaagcuu

SEQ ID NO: 1900 - RNA, 20 nt, Artificial Sequence
  Synthetic
cuaugagccagcaaaagcuu

SEQ ID NO: 1901 - RNA, 22 nt, Artificial Sequence
  Synthetic
cagagugcauccaugguccagg

SEQ ID NO: 1902 - RNA, 21 nt, Artificial Sequence
  Synthetic
cugaaauauuaagggcucuuc

SEQ ID NO: 1903 - RNA, 21 nt, Artificial Sequence
  Synthetic
cucuauaccuuuuacugagga

SEQ ID NO: 1904 - RNA, 19 nt, Artificial Sequence
  Synthetic
cuauaccuuuuacugagga

SEQ ID NO: 1905 - RNA, 24 nt, Artificial Sequence
  Synthetic
cacuugaacucuauaccuuuuacu

SEQ ID NO: 1906 - RNA, 22 nt, Artificial Sequence
  Synthetic
cuugaacucuauaccuuuuacu

SEQ ID NO: 1907 - RNA, 20 nt, Artificial Sequence
  Synthetic
ccaacaguagcugaaauauu

SEQ ID NO: 1908 - RNA, 19 nt, Artificial Sequence
  Synthetic
caacaguagcugaaauauu

SEQ ID NO: 1909 - RNA, 24 nt, Artificial Sequence
  Synthetic
cauccauuccaaggaacaaaagcc

SEQ ID NO: 1910 - RNA, 21 nt, Artificial Sequence
  Synthetic
ccauuccaaggaacaaaagcc

SEQ ID NO: 1911 - RNA, 20 nt, Artificial Sequence
  Synthetic
cauuccaaggaacaaaagcc

SEQ ID NO: 1912 - RNA, 22 nt, Artificial Sequence
  Synthetic
cccuuucucuuaccccuguacc

SEQ ID NO: 1913 - RNA, 21 nt, Artificial Sequence
  Synthetic
ccuuucucuuaccccuguacc

SEQ ID NO: 1914 - RNA, 20 nt, Artificial Sequence
  Synthetic
cuuucucuuaccccuguacc

SEQ ID NO: 1915 - RNA, 20 nt, Artificial Sequence
  Synthetic
cuuucuaaugcuggagagga

SEQ ID NO: 1916 - RNA, 23 nt, Artificial Sequence
  Synthetic
cuaaugcuggagaggauaggaca

SEQ ID NO: 1917 - RNA, 21 nt, Artificial Sequence
  Synthetic
cauaaguuacaaucugugaau

SEQ ID NO: 1918 - RNA, 19 nt, Artificial Sequence
  Synthetic
ccagacaucuaagagaaaa

SEQ ID NO: 1919 - RNA, 18 nt, Artificial Sequence
  Synthetic
cagacaucuaagagaaaa

SEQ ID NO: 1920 - RNA, 21 nt, Artificial Sequence
  Synthetic
ccucuauuucugaugaggaag

SEQ ID NO: 1921 - RNA, 20 nt, Artificial Sequence
  Synthetic
cucuauuucugaugaggaag

SEQ ID NO: 1922 - RNA, 18 nt, Artificial Sequence
  Synthetic
cuauuucugaugaggaag

SEQ ID NO: 1923 - RNA, 23 nt, Artificial Sequence
  Synthetic
cugaugaggaagaugaacaaauc

SEQ ID NO: 1924 - RNA, 20 nt, Artificial Sequence
  Synthetic
cauuuacugaaugugucucu

SEQ ID NO: 1925 - RNA, 18 nt, Artificial Sequence
  Synthetic
cagggguaagagaaaggg

SEQ ID NO: 1926 - RNA, 19 nt, Artificial Sequence
  Synthetic
guuggcuacauccauucca

SEQ ID NO: 1927 - RNA, 19 nt, Artificial Sequence
  Synthetic
guaguuaucuuacagccac

SEQ ID NO: 1928 - RNA, 24 nt, Artificial Sequence
  Synthetic
gucucuaugagccagcaaaagcuu

SEQ ID NO: 1929 - RNA, 20 nt, Artificial Sequence
  Synthetic
gagugcauccaugguccagg

SEQ ID NO: 1930 - RNA, 18 nt, Artificial Sequence
  Synthetic
gugcauccaugguccagg

SEQ ID NO: 1931 - RNA, 22 nt, Artificial Sequence
  Synthetic
gcugaaauauuaagggcucuuc

SEQ ID NO: 1932 - RNA, 19 nt, Artificial Sequence
  Synthetic
gaaauauuaagggcucuuc

SEQ ID NO: 1933 - RNA, 24 nt, Artificial Sequence
  Synthetic
gaacucuauaccuuuuacugagga

SEQ ID NO: 1934 - RNA, 19 nt, Artificial Sequence
  Synthetic
gaacucuauaccuuuuacu

SEQ ID NO: 1935 - RNA, 21 nt, Artificial Sequence
  Synthetic
guaggaauccugaaagcuacu

SEQ ID NO: 1936 - RNA, 18 nt, Artificial Sequence
  Synthetic
ggaauccugaaagcuacu

SEQ ID NO: 1937 - RNA, 24 nt, Artificial Sequence
  Synthetic
guagccaacaguagcugaaauauu

SEQ ID NO: 1938 - RNA, 21 nt, Artificial Sequence
  Synthetic
gccaacaguagcugaaauauu

SEQ ID NO: 1939 - RNA, 23 nt, Artificial Sequence
  Synthetic
ggacuuucuaaugcuggagagga

SEQ ID NO: 1940 - RNA, 22 nt, Artificial Sequence
  Synthetic
gacuuucuaaugcuggagagga

SEQ ID NO: 1941 - RNA, 18 nt, Artificial Sequence
  Synthetic
gcuggagaggauaggaca

SEQ ID NO: 1942 - RNA, 22 nt, Artificial Sequence
  Synthetic
gccucuauuucugaugaggaag

SEQ ID NO: 1943 - RNA, 21 nt, Artificial Sequence
  Synthetic
gaugaggaagaugaacaaauc

SEQ ID NO: 1944 - RNA, 18 nt, Artificial Sequence
  Synthetic
gaggaagaugaacaaauc

SEQ ID NO: 1945 - RNA, 23 nt, Artificial Sequence
  Synthetic
ggguacagggguaagagaaaggg

SEQ ID NO: 1946 - RNA, 22 nt, Artificial Sequence
  Synthetic
gguacagggguaagagaaaggg

SEQ ID NO: 1947 - RNA, 21 nt, Artificial Sequence
  Synthetic
guacagggguaagagaaaggg

SEQ ID NO: 1948 - RNA, 23 nt, Artificial Sequence
  Synthetic
guguguguguguguguguuaugu

SEQ ID NO: 1949 - RNA, 21 nt, Artificial Sequence
  Synthetic
guguguguguguguguuaugu

SEQ ID NO: 1950 - RNA, 19 nt, Artificial Sequence
  Synthetic
guguguguguguguuaugu

SEQ ID NO: 1951 - RNA, 23 nt, Artificial Sequence
  Synthetic
uacuguuggcuacauccauucca

SEQ ID NO: 1952 - RNA, 20 nt, Artificial Sequence
  Synthetic
uguuggcuacauccauucca

SEQ ID NO: 1953 - RNA, 18 nt, Artificial Sequence
  Synthetic
uuggcuacauccauucca

SEQ ID NO: 1954 - RNA, 23 nt, Artificial Sequence
  Synthetic
uuauccacaagaugucucuugcc

SEQ ID NO: 1955 - RNA, 22 nt, Artificial Sequence
  Synthetic
uauccacaagaugucucuugcc

SEQ ID NO: 1956 - RNA, 20 nt, Artificial Sequence
  Synthetic
uccacaagaugucucuugcc

SEQ ID NO: 1957 - RNA, 22 nt, Artificial Sequence
  Synthetic
uuuguaguuaucuuacagccac

SEQ ID NO: 1958 - RNA, 21 nt, Artificial Sequence
  Synthetic
uuguaguuaucuuacagccac

SEQ ID NO: 1959 - RNA, 20 nt, Artificial Sequence
  Synthetic
uguaguuaucuuacagccac

SEQ ID NO: 1960 - RNA, 18 nt, Artificial Sequence
  Synthetic
uaguuaucuuacagccac

SEQ ID NO: 1961 - RNA, 23 nt, Artificial Sequence
  Synthetic
ucucuaugagccagcaaaagcuu

SEQ ID NO: 1962 - RNA, 21 nt, Artificial Sequence
  Synthetic
ucuaugagccagcaaaagcuu

SEQ ID NO: 1963 - RNA, 19 nt, Artificial Sequence
  Synthetic
uaugagccagcaaaagcuu

SEQ ID NO: 1964 - RNA, 24 nt, Artificial Sequence
  Synthetic
uacagagugcauccaugguccagg

SEQ ID NO: 1965 - RNA, 24 nt, Artificial Sequence
  Synthetic
uagcugaaauauuaagggcucuuc

SEQ ID NO: 1966 - RNA, 20 nt, Artificial Sequence
  Synthetic
ugaaauauuaagggcucuuc

SEQ ID NO: 1967 - RNA, 20 nt, Artificial Sequence
  Synthetic
ucuauaccuuuuacugagga

SEQ ID NO: 1968 - RNA, 18 nt, Artificial Sequence
  Synthetic
uauaccuuuuacugagga

SEQ ID NO: 1969 - RNA, 21 nt, Artificial Sequence
  Synthetic
uugaacucuauaccuuuuacu

SEQ ID NO: 1970 - RNA, 20 nt, Artificial Sequence
  Synthetic
ugaacucuauaccuuuuacu

SEQ ID NO: 1971 - RNA, 24 nt, Artificial Sequence
  Synthetic
uuaguaggaauccugaaagcuacu

SEQ ID NO: 1972 - RNA, 23 nt, Artificial Sequence
  Synthetic
uaguaggaauccugaaagcuacu

SEQ ID NO: 1973 - RNA, 20 nt, Artificial Sequence
  Synthetic
uaggaauccugaaagcuacu

SEQ ID NO: 1974 - RNA, 23 nt, Artificial Sequence
  Synthetic
uagccaacaguagcugaaauauu

SEQ ID NO: 1975 - RNA, 22 nt, Artificial Sequence
  Synthetic
uccauuccaaggaacaaaagcc

SEQ ID NO: 1976 - RNA, 18 nt, Artificial Sequence
  Synthetic
uuccaaggaacaaaagcc

SEQ ID NO: 1977 - RNA, 23 nt, Artificial Sequence
  Synthetic
ucccuuucucuuaccccuguacc

SEQ ID NO: 1978 - RNA, 19 nt, Artificial Sequence
  Synthetic
uuucucuuaccccuguacc

SEQ ID NO: 1979 - RNA, 18 nt, Artificial Sequence
  Synthetic
uucucuuaccccuguacc

SEQ ID NO: 1980 - RNA, 19 nt, Artificial Sequence
  Synthetic
uuucuaaugcuggagagga

SEQ ID NO: 1981 - RNA, 18 nt, Artificial Sequence
  Synthetic
uucuaaugcuggagagga

SEQ ID NO: 1982 - RNA, 24 nt, Artificial Sequence
  Synthetic
ucuaaugcuggagaggauaggaca

SEQ ID NO: 1983 - RNA, 22 nt, Artificial Sequence
  Synthetic
uaaugcuggagaggauaggaca

SEQ ID NO: 1984 - RNA, 19 nt, Artificial Sequence
  Synthetic
ugcuggagaggauaggaca

SEQ ID NO: 1985 - RNA, 24 nt, Artificial Sequence
  Synthetic
uaucauaaguuacaaucugugaau

SEQ ID NO: 1986 - RNA, 22 nt, Artificial Sequence
  Synthetic
ucauaaguuacaaucugugaau

SEQ ID NO: 1987 - RNA, 19 nt, Artificial Sequence
  Synthetic
uaaguuacaaucugugaau

SEQ ID NO: 1988 - RNA, 24 nt, Artificial Sequence
  Synthetic
uuuaaccagacaucuaagagaaaa

SEQ ID NO: 1989 - RNA, 23 nt, Artificial Sequence
  Synthetic
uuaaccagacaucuaagagaaaa

SEQ ID NO: 1990 - RNA, 22 nt, Artificial Sequence
  Synthetic
uaaccagacaucuaagagaaaa

SEQ ID NO: 1991 - RNA, 19 nt, Artificial Sequence
  Synthetic
ucuauuucugaugaggaag

SEQ ID NO: 1992 - RNA, 24 nt, Artificial Sequence
  Synthetic
ucugaugaggaagaugaacaaauc

SEQ ID NO: 1993 - RNA, 22 nt, Artificial Sequence
  Synthetic
ugaugaggaagaugaacaaauc

SEQ ID NO: 1994 - RNA, 19 nt, Artificial Sequence
  Synthetic
ugaggaagaugaacaaauc

SEQ ID NO: 1995 - RNA, 24 nt, Artificial Sequence
  Synthetic
uuuucauuuacugaaugugucucu

SEQ ID NO: 1996 - RNA, 23 nt, Artificial Sequence
  Synthetic
uuucauuuacugaaugugucucu

SEQ ID NO: 1997 - RNA, 22 nt, Artificial Sequence
  Synthetic
uucauuuacugaaugugucucu

SEQ ID NO: 1998 - RNA, 21 nt, Artificial Sequence
  Synthetic
ucauuuacugaaugugucucu

SEQ ID NO: 1999 - RNA, 18 nt, Artificial Sequence
  Synthetic
uuuacugaaugugucucu

SEQ ID NO: 2000 - RNA, 24 nt, Artificial Sequence
  Synthetic
uggguacagggguaagagaaaggg

SEQ ID NO: 2001 - RNA, 20 nt, Artificial Sequence
  Synthetic
uacagggguaagagaaaggg

SEQ ID NO: 2002 - RNA, 24 nt, Artificial Sequence
  Synthetic
uguguguguguguguguguuaugu

SEQ ID NO: 2003 - RNA, 22 nt, Artificial Sequence
  Synthetic
uguguguguguguguguuaugu

SEQ ID NO: 2004 - RNA, 20 nt, Artificial Sequence
  Synthetic
uguguguguguguguuaugu

SEQ ID NO: 2005 - RNA, 18 nt, Artificial Sequence
  Synthetic
uguguguguguguuaugu

SEQ ID NO: 2006 - RNA, 24 nt, Artificial Sequence
  Synthetic
auuuacagagugcauccauggucc

SEQ ID NO: 2007 - RNA, 20 nt, Artificial Sequence
  Synthetic
acagagugcauccauggucc

SEQ ID NO: 2008 - RNA, 18 nt, Artificial Sequence
  Synthetic
agagugcauccauggucc

SEQ ID NO: 2009 - RNA, 21 nt, Artificial Sequence
  Synthetic
acuugaacucuauaccuuuua

SEQ ID NO: 2010 - RNA, 22 nt, Artificial Sequence
  Synthetic
agcuaaaucaugcaagugaccu

SEQ ID NO: 2011 - RNA, 18 nt, Artificial Sequence
  Synthetic
aaaucaugcaagugaccu

SEQ ID NO: 2012 - RNA, 24 nt, Artificial Sequence
  Synthetic
auccauaagccucuauuucugaug

SEQ ID NO: 2013 - RNA, 20 nt, Artificial Sequence
  Synthetic
auaagccucuauuucugaug

SEQ ID NO: 2014 - RNA, 18 nt, Artificial Sequence
  Synthetic
aagccucuauuucugaug

SEQ ID NO: 2015 - RNA, 20 nt, Artificial Sequence
  Synthetic
agaauaguuuguucugggua

SEQ ID NO: 2016 - RNA, 18 nt, Artificial Sequence
  Synthetic
aauaguuuguucugggua

SEQ ID NO: 2017 - RNA, 24 nt, Artificial Sequence
  Synthetic
aggagaaugaucuagauaaucauu

SEQ ID NO: 2018 - RNA, 21 nt, Artificial Sequence
  Synthetic
agaaugaucuagauaaucauu

SEQ ID NO: 2019 - RNA, 19 nt, Artificial Sequence
  Synthetic
aaugaucuagauaaucauu

SEQ ID NO: 2020 - RNA, 18 nt, Artificial Sequence
  Synthetic
augaucuagauaaucauu

SEQ ID NO: 2021 - RNA, 19 nt, Artificial Sequence
  Synthetic
aaugcuggagaggauagga

SEQ ID NO: 2022 - RNA, 18 nt, Artificial Sequence
  Synthetic
augcuggagaggauagga

SEQ ID NO: 2023 - RNA, 24 nt, Artificial Sequence
  Synthetic
aaaauccauaagccucuauuucug

SEQ ID NO: 2024 - RNA, 23 nt, Artificial Sequence
  Synthetic
aaauccauaagccucuauuucug

SEQ ID NO: 2025 - RNA, 22 nt, Artificial Sequence
  Synthetic
aauccauaagccucuauuucug

SEQ ID NO: 2026 - RNA, 21 nt, Artificial Sequence
  Synthetic
auccauaagccucuauuucug

SEQ ID NO: 2027 - RNA, 23 nt, Artificial Sequence
  Synthetic
aaacagguagaauauuguaauca

SEQ ID NO: 2028 - RNA, 22 nt, Artificial Sequence
  Synthetic
aacagguagaauauuguaauca

SEQ ID NO: 2029 - RNA, 21 nt, Artificial Sequence
  Synthetic
acagguagaauauuguaauca

SEQ ID NO: 2030 - RNA, 19 nt, Artificial Sequence
  Synthetic
agguagaauauuguaauca

SEQ ID NO: 2031 - RNA, 22 nt, Artificial Sequence
  Synthetic
aaggaacaaaagccagggacca

SEQ ID NO: 2032 - RNA, 21 nt, Artificial Sequence
  Synthetic
aggaacaaaagccagggacca

SEQ ID NO: 2033 - RNA, 18 nt, Artificial Sequence
  Synthetic
aacaaaagccagggacca

SEQ ID NO: 2034 - RNA, 24 nt, Artificial Sequence
  Synthetic
agguagaauauuguaaucaaagga

SEQ ID NO: 2035 - RNA, 20 nt, Artificial Sequence
  Synthetic
agaauauuguaaucaaagga

SEQ ID NO: 2036 - RNA, 18 nt, Artificial Sequence
  Synthetic
aauauuguaaucaaagga

SEQ ID NO: 2037 - RNA, 22 nt, Artificial Sequence
  Synthetic
agucauguuuaucaauauuauu

SEQ ID NO: 2038 - RNA, 18 nt, Artificial Sequence
  Synthetic
auguuuaucaauauuauu

SEQ ID NO: 2039 - RNA, 20 nt, Artificial Sequence
  Synthetic
aaccagacaucuaagagaaa

SEQ ID NO: 2040 - RNA, 19 nt, Artificial Sequence
  Synthetic
accagacaucuaagagaaa

SEQ ID NO: 2041 - RNA, 22 nt, Artificial Sequence
  Synthetic
auucuuaucuaagauccuuuca

SEQ ID NO: 2042 - RNA, 24 nt, Artificial Sequence
  Synthetic
aaacagguagaauauuguaaucaa

SEQ ID NO: 2043 - RNA, 23 nt, Artificial Sequence
  Synthetic
aacagguagaauauuguaaucaa

SEQ ID NO: 2044 - RNA, 22 nt, Artificial Sequence
  Synthetic
acagguagaauauuguaaucaa

SEQ ID NO: 2045 - RNA, 20 nt, Artificial Sequence
  Synthetic
agguagaauauuguaaucaa

SEQ ID NO: 2046 - RNA, 19 nt, Artificial Sequence
  Synthetic
augaggaagaugaacaaau

SEQ ID NO: 2047 - RNA, 19 nt, Artificial Sequence
  Synthetic
agaggauaggacagaggac

SEQ ID NO: 2048 - RNA, 19 nt, Artificial Sequence
  Synthetic
cagagugcauccauggucc

SEQ ID NO: 2049 - RNA, 24 nt, Artificial Sequence
  Synthetic
cuugccuaggacuuucuaaugcug

SEQ ID NO: 2050 - RNA, 20 nt, Artificial Sequence
  Synthetic
ccuaggacuuucuaaugcug

SEQ ID NO: 2051 - RNA, 19 nt, Artificial Sequence
  Synthetic
cuaggacuuucuaaugcug

SEQ ID NO: 2052 - RNA, 23 nt, Artificial Sequence
  Synthetic
ccacuugaacucuauaccuuuua

SEQ ID NO: 2053 - RNA, 22 nt, Artificial Sequence
  Synthetic
cacuugaacucuauaccuuuua

SEQ ID NO: 2054 - RNA, 20 nt, Artificial Sequence
  Synthetic
cuugaacucuauaccuuuua

SEQ ID NO: 2055 - RNA, 23 nt, Artificial Sequence
  Synthetic
cagcuaaaucaugcaagugaccu

SEQ ID NO: 2056 - RNA, 20 nt, Artificial Sequence
  Synthetic
cuaaaucaugcaagugaccu

SEQ ID NO: 2057 - RNA, 23 nt, Artificial Sequence
  Synthetic
cucuugccuaggacuuucuaaug

SEQ ID NO: 2058 - RNA, 21 nt, Artificial Sequence
  Synthetic
cuugccuaggacuuucuaaug

SEQ ID NO: 2059 - RNA, 22 nt, Artificial Sequence
  Synthetic
ccauaagccucuauuucugaug

SEQ ID NO: 2060 - RNA, 21 nt, Artificial Sequence
  Synthetic
cauaagccucuauuucugaug

SEQ ID NO: 2061 - RNA, 21 nt, Artificial Sequence
  Synthetic
cuaaugcuggagaggauagga

SEQ ID NO: 2062 - RNA, 19 nt, Artificial Sequence
  Synthetic
ccauaagccucuauuucug

SEQ ID NO: 2063 - RNA, 18 nt, Artificial Sequence
  Synthetic
cauaagccucuauuucug

SEQ ID NO: 2064 - RNA, 20 nt, Artificial Sequence
  Synthetic
cagguagaauauuguaauca

SEQ ID NO: 2065 - RNA, 21 nt, Artificial Sequence
  Synthetic
cuuucugcugcuuuugccaaa

SEQ ID NO: 2066 - RNA, 24 nt, Artificial Sequence
  Synthetic
ccaaggaacaaaagccagggacca

SEQ ID NO: 2067 - RNA, 23 nt, Artificial Sequence
  Synthetic
caaggaacaaaagccagggacca

SEQ ID NO: 2068 - RNA, 19 nt, Artificial Sequence
  Synthetic
cucuuagaugucugguuaa

SEQ ID NO: 2069 - RNA, 19 nt, Artificial Sequence
  Synthetic
cauguuuaucaauauuauu

SEQ ID NO: 2070 - RNA, 18 nt, Artificial Sequence
  Synthetic
ccagacaucuaagagaaa

SEQ ID NO: 2071 - RNA, 19 nt, Artificial Sequence
  Synthetic
cuuaucuaagauccuuuca

SEQ ID NO: 2072 - RNA, 21 nt, Artificial Sequence
  Synthetic
cagguagaauauuguaaucaa

SEQ ID NO: 2073 - RNA, 22 nt, Artificial Sequence
  Synthetic
cugaugaggaagaugaacaaau

SEQ ID NO: 2074 - RNA, 23 nt, Artificial Sequence
  Synthetic
cuggagaggauaggacagaggac

SEQ ID NO: 2075 - RNA, 18 nt, Artificial Sequence
  Synthetic
caucuuccucaucagaaa

SEQ ID NO: 2076 - RNA, 21 nt, Artificial Sequence
  Synthetic
gccuaggacuuucuaaugcug

SEQ ID NO: 2077 - RNA, 24 nt, Artificial Sequence
  Synthetic
gccacuugaacucuauaccuuuua

SEQ ID NO: 2078 - RNA, 21 nt, Artificial Sequence
  Synthetic
gcuaaaucaugcaagugaccu

SEQ ID NO: 2079 - RNA, 18 nt, Artificial Sequence
  Synthetic
gccuaggacuuucuaaug

SEQ ID NO: 2080 - RNA, 23 nt, Artificial Sequence
  Synthetic
gggagaauaguuuguucugggua

SEQ ID NO: 2081 - RNA, 22 nt, Artificial Sequence
  Synthetic
ggagaauaguuuguucugggua

SEQ ID NO: 2082 - RNA, 21 nt, Artificial Sequence
  Synthetic
gagaauaguuuguucugggua

SEQ ID NO: 2083 - RNA, 19 nt, Artificial Sequence
  Synthetic
gaauaguuuguucugggua

SEQ ID NO: 2084 - RNA, 23 nt, Artificial Sequence
  Synthetic
ggagaaugaucuagauaaucauu

SEQ ID NO: 2085 - RNA, 22 nt, Artificial Sequence
  Synthetic
gagaaugaucuagauaaucauu

SEQ ID NO: 2086 - RNA, 20 nt, Artificial Sequence
  Synthetic
gaaugaucuagauaaucauu

SEQ ID NO: 2087 - RNA, 24 nt, Artificial Sequence
  Synthetic
gaaacagguagaauauuguaauca

SEQ ID NO: 2088 - RNA, 18 nt, Artificial Sequence
  Synthetic
gguagaauauuguaauca

SEQ ID NO: 2089 - RNA, 22 nt, Artificial Sequence
  Synthetic
gcuuucugcugcuuuugccaaa

SEQ ID NO: 2090 - RNA, 19 nt, Artificial Sequence
  Synthetic
gaacaaaagccagggacca

SEQ ID NO: 2091 - RNA, 23 nt, Artificial Sequence
  Synthetic
gguagaauauuguaaucaaagga

SEQ ID NO: 2092 - RNA, 22 nt, Artificial Sequence
  Synthetic
guagaauauuguaaucaaagga

SEQ ID NO: 2093 - RNA, 19 nt, Artificial Sequence
  Synthetic
gaauauuguaaucaaagga

SEQ ID NO: 2094 - RNA, 23 nt, Artificial Sequence
  Synthetic
gagucauguuuaucaauauuauu

SEQ ID NO: 2095 - RNA, 21 nt, Artificial Sequence
  Synthetic
gucauguuuaucaauauuauu

SEQ ID NO: 2096 - RNA, 19 nt, Artificial Sequence
  Synthetic
gguagaauauuguaaucaa

SEQ ID NO: 2097 - RNA, 18 nt, Artificial Sequence
  Synthetic
guagaauauuguaaucaa

SEQ ID NO: 2098 - RNA, 20 nt, Artificial Sequence
  Synthetic
gaugaggaagaugaacaaau

SEQ ID NO: 2099 - RNA, 24 nt, Artificial Sequence
  Synthetic
gcuggagaggauaggacagaggac

SEQ ID NO: 2100 - RNA, 21 nt, Artificial Sequence
  Synthetic
ggagaggauaggacagaggac

SEQ ID NO: 2101 - RNA, 20 nt, Artificial Sequence
  Synthetic
gagaggauaggacagaggac

SEQ ID NO: 2102 - RNA, 18 nt, Artificial Sequence
  Synthetic
gaggauaggacagaggac

SEQ ID NO: 2103 - RNA, 21 nt, Artificial Sequence
  Synthetic
guucaucuuccucaucagaaa

SEQ ID NO: 2104 - RNA, 23 nt, Artificial Sequence
  Synthetic
uuuacagagugcauccauggucc

SEQ ID NO: 2105 - RNA, 22 nt, Artificial Sequence
  Synthetic
uuacagagugcauccauggucc

SEQ ID NO: 2106 - RNA, 21 nt, Artificial Sequence
  Synthetic
uacagagugcauccauggucc

SEQ ID NO: 2107 - RNA, 23 nt, Artificial Sequence
  Synthetic
uugccuaggacuuucuaaugcug

SEQ ID NO: 2108 - RNA, 22 nt, Artificial Sequence
  Synthetic
ugccuaggacuuucuaaugcug

SEQ ID NO: 2109 - RNA, 18 nt, Artificial Sequence
  Synthetic
uaggacuuucuaaugcug

SEQ ID NO: 2110 - RNA, 19 nt, Artificial Sequence
  Synthetic
uugaacucuauaccuuuua

SEQ ID NO: 2111 - RNA, 18 nt, Artificial Sequence
  Synthetic
ugaacucuauaccuuuua

SEQ ID NO: 2112 - RNA, 24 nt, Artificial Sequence
  Synthetic
ucagcuaaaucaugcaagugaccu

SEQ ID NO: 2113 - RNA, 19 nt, Artificial Sequence
  Synthetic
uaaaucaugcaagugaccu

SEQ ID NO: 2114 - RNA, 24 nt, Artificial Sequence
  Synthetic
ucucuugccuaggacuuucuaaug

SEQ ID NO: 2115 - RNA, 22 nt, Artificial Sequence
  Synthetic
ucuugccuaggacuuucuaaug

SEQ ID NO: 2116 - RNA, 20 nt, Artificial Sequence
  Synthetic
uugccuaggacuuucuaaug

SEQ ID NO: 2117 - RNA, 19 nt, Artificial Sequence
  Synthetic
ugccuaggacuuucuaaug

SEQ ID NO: 2118 - RNA, 23 nt, Artificial Sequence
  Synthetic
uccauaagccucuauuucugaug

SEQ ID NO: 2119 - RNA, 19 nt, Artificial Sequence
  Synthetic
uaagccucuauuucugaug

SEQ ID NO: 2120 - RNA, 24 nt, Artificial Sequence
  Synthetic
ugggagaauaguuuguucugggua

SEQ ID NO: 2121 - RNA, 24 nt, Artificial Sequence
  Synthetic
uuucuaaugcuggagaggauagga

SEQ ID NO: 2122 - RNA, 23 nt, Artificial Sequence
  Synthetic
uucuaaugcuggagaggauagga

SEQ ID NO: 2123 - RNA, 22 nt, Artificial Sequence
  Synthetic
ucuaaugcuggagaggauagga

SEQ ID NO: 2124 - RNA, 20 nt, Artificial Sequence
  Synthetic
uaaugcuggagaggauagga

SEQ ID NO: 2125 - RNA, 20 nt, Artificial Sequence
  Synthetic
uccauaagccucuauuucug

SEQ ID NO: 2126 - RNA, 24 nt, Artificial Sequence
  Synthetic
uugcuuucugcugcuuuugccaaa

SEQ ID NO: 2127 - RNA, 23 nt, Artificial Sequence
  Synthetic
ugcuuucugcugcuuuugccaaa

SEQ ID NO: 2128 - RNA, 20 nt, Artificial Sequence
  Synthetic
uuucugcugcuuuugccaaa

SEQ ID NO: 2129 - RNA, 19 nt, Artificial Sequence
  Synthetic
uucugcugcuuuugccaaa

SEQ ID NO: 2130 - RNA, 18 nt, Artificial Sequence
  Synthetic
ucugcugcuuuugccaaa

SEQ ID NO: 2131 - RNA, 21 nt, Artificial Sequence
  Synthetic
uagaauauuguaaucaaagga

SEQ ID NO: 2132 - RNA, 24 nt, Artificial Sequence
  Synthetic
uuuuucucuuagaugucugguuaa

SEQ ID NO: 2133 - RNA, 23 nt, Artificial Sequence
  Synthetic
uuuucucuuagaugucugguuaa

SEQ ID NO: 2134 - RNA, 22 nt, Artificial Sequence
  Synthetic
uuucucuuagaugucugguuaa

SEQ ID NO: 2135 - RNA, 21 nt, Artificial Sequence
  Synthetic
uucucuuagaugucugguuaa

SEQ ID NO: 2136 - RNA, 20 nt, Artificial Sequence
  Synthetic
ucucuuagaugucugguuaa

SEQ ID NO: 2137 - RNA, 18 nt, Artificial Sequence
  Synthetic
ucuuagaugucugguuaa

SEQ ID NO: 2138 - RNA, 24 nt, Artificial Sequence
  Synthetic
ugagucauguuuaucaauauuauu

SEQ ID NO: 2139 - RNA, 20 nt, Artificial Sequence
  Synthetic
ucauguuuaucaauauuauu

SEQ ID NO: 2140 - RNA, 24 nt, Artificial Sequence
  Synthetic
uuuuaaccagacaucuaagagaaa

SEQ ID NO: 2141 - RNA, 23 nt, Artificial Sequence
  Synthetic
uuuaaccagacaucuaagagaaa

SEQ ID NO: 2142 - RNA, 22 nt, Artificial Sequence
  Synthetic
uuaaccagacaucuaagagaaa

SEQ ID NO: 2143 - RNA, 21 nt, Artificial Sequence
  Synthetic
uaaccagacaucuaagagaaa

SEQ ID NO: 2144 - RNA, 24 nt, Artificial Sequence
  Synthetic
uuauucuuaucuaagauccuuuca

SEQ ID NO: 2145 - RNA, 23 nt, Artificial Sequence
  Synthetic
uauucuuaucuaagauccuuuca

SEQ ID NO: 2146 - RNA, 21 nt, Artificial Sequence
  Synthetic
uucuuaucuaagauccuuuca

SEQ ID NO: 2147 - RNA, 20 nt, Artificial Sequence
  Synthetic
ucuuaucuaagauccuuuca

SEQ ID NO: 2148 - RNA, 18 nt, Artificial Sequence
  Synthetic
uuaucuaagauccuuuca

SEQ ID NO: 2149 - RNA, 24 nt, Artificial Sequence
  Synthetic
uucugaugaggaagaugaacaaau

SEQ ID NO: 2150 - RNA, 23 nt, Artificial Sequence
  Synthetic
ucugaugaggaagaugaacaaau

SEQ ID NO: 2151 - RNA, 21 nt, Artificial Sequence
  Synthetic
ugaugaggaagaugaacaaau

SEQ ID NO: 2152 - RNA, 18 nt, Artificial Sequence
  Synthetic
ugaggaagaugaacaaau

SEQ ID NO: 2153 - RNA, 22 nt, Artificial Sequence
  Synthetic
uggagaggauaggacagaggac

SEQ ID NO: 2154 - RNA, 24 nt, Artificial Sequence
  Synthetic
uuuguucaucuuccucaucagaaa

SEQ ID NO: 2155 - RNA, 23 nt, Artificial Sequence
  Synthetic
uuguucaucuuccucaucagaaa

SEQ ID NO: 2156 - RNA, 22 nt, Artificial Sequence
  Synthetic
uguucaucuuccucaucagaaa

SEQ ID NO: 2157 - RNA, 20 nt, Artificial Sequence
  Synthetic
uucaucuuccucaucagaaa

SEQ ID NO: 2158 - RNA, 19 nt, Artificial Sequence
  Synthetic
ucaucuuccucaucagaaa

SEQ ID NO: 2159 - RNA, 23 nt, Artificial Sequence
  Synthetic
acuuaccucaugucaucuagagc

SEQ ID NO: 2160 - RNA, 19 nt, Artificial Sequence
  Synthetic
accucaugucaucuagagc

SEQ ID NO: 2161 - RNA, 24 nt, Artificial Sequence
  Synthetic
acaguuuuuaaggcggggagucac

SEQ ID NO: 2162 - RNA, 22 nt, Artificial Sequence
  Synthetic
aguuuuuaaggcggggagucac

SEQ ID NO: 2163 - RNA, 19 nt, Artificial Sequence
  Synthetic
acagaguucaagcuaauac

SEQ ID NO: 2164 - RNA, 24 nt, Artificial Sequence
  Synthetic
auuagcuugaacucugugccaaac

SEQ ID NO: 2165 - RNA, 21 nt, Artificial Sequence
  Synthetic
agcuugaacucugugccaaac

SEQ ID NO: 2166 - RNA, 22 nt, Artificial Sequence
  Synthetic
auguggugucaaauauggugcu

SEQ ID NO: 2167 - RNA, 23 nt, Artificial Sequence
  Synthetic
auguggugucaaauauggugcuu

SEQ ID NO: 2168 - RNA, 18 nt, Artificial Sequence
  Synthetic
agaugacaugagguaagu

SEQ ID NO: 2169 - RNA, 22 nt, Artificial Sequence
  Synthetic
aauacaugagagugauuagugg

SEQ ID NO: 2170 - RNA, 21 nt, Artificial Sequence
  Synthetic
auacaugagagugauuagugg

SEQ ID NO: 2171 - RNA, 19 nt, Artificial Sequence
  Synthetic
acaugagagugauuagugg

SEQ ID NO: 2172 - RNA, 24 nt, Artificial Sequence
  Synthetic
aagacacugccaauagggauaggu

SEQ ID NO: 2173 - RNA, 23 nt, Artificial Sequence
  Synthetic
agacacugccaauagggauaggu

SEQ ID NO: 2174 - RNA, 21 nt, Artificial Sequence
  Synthetic
acacugccaauagggauaggu

SEQ ID NO: 2175 - RNA, 19 nt, Artificial Sequence
  Synthetic
acugccaauagggauaggu

SEQ ID NO: 2176 - RNA, 23 nt, Artificial Sequence
  Synthetic
aaagguucaugagacuagagguc

SEQ ID NO: 2177 - RNA, 22 nt, Artificial Sequence
  Synthetic
aagguucaugagacuagagguc

SEQ ID NO: 2178 - RNA, 21 nt, Artificial Sequence
  Synthetic
agguucaugagacuagagguc

SEQ ID NO: 2179 - RNA, 21 nt, Artificial Sequence
  Synthetic
aaacaggagauacucaacaca

SEQ ID NO: 2180 - RNA, 20 nt, Artificial Sequence
  Synthetic
aacaggagauacucaacaca

SEQ ID NO: 2181 - RNA, 19 nt, Artificial Sequence
  Synthetic
acaggagauacucaacaca

SEQ ID NO: 2182 - RNA, 23 nt, Artificial Sequence
  Synthetic
agcacguacaaaagaacauacau

SEQ ID NO: 2183 - RNA, 20 nt, Artificial Sequence
  Synthetic
acguacaaaagaacauacau

SEQ ID NO: 2184 - RNA, 19 nt, Artificial Sequence
  Synthetic
aguaaggaggauguaagac

SEQ ID NO: 2185 - RNA, 21 nt, Artificial Sequence
  Synthetic
agcuuuugacaguuuuuaagg

SEQ ID NO: 2186 - RNA, 24 nt, Artificial Sequence
  Synthetic
aaauucacugagcaaaacaacugg

SEQ ID NO: 2187 - RNA, 23 nt, Artificial Sequence
  Synthetic
aauucacugagcaaaacaacugg

SEQ ID NO: 2188 - RNA, 22 nt, Artificial Sequence
  Synthetic
auucacugagcaaaacaacugg

SEQ ID NO: 2189 - RNA, 18 nt, Artificial Sequence
  Synthetic
acugagcaaaacaacugg

SEQ ID NO: 2190 - RNA, 20 nt, Artificial Sequence
  Synthetic
aacaaguuuugaaacaggaa

SEQ ID NO: 2191 - RNA, 19 nt, Artificial Sequence
  Synthetic
acaaguuuugaaacaggaa

SEQ ID NO: 2192 - RNA, 22 nt, Artificial Sequence
  Synthetic
aaugccugaacaaguuuugaaa

SEQ ID NO: 2193 - RNA, 21 nt, Artificial Sequence
  Synthetic
augccugaacaaguuuugaaa

SEQ ID NO: 2194 - RNA, 24 nt, Artificial Sequence
  Synthetic
auucacugagcaaaacaacuggaa

SEQ ID NO: 2195 - RNA, 20 nt, Artificial Sequence
  Synthetic
acugagcaaaacaacuggaa

SEQ ID NO: 2196 - RNA, 24 nt, Artificial Sequence
  Synthetic
aaaaagguaaugccugaacaaguu

SEQ ID NO: 2197 - RNA, 23 nt, Artificial Sequence
  Synthetic
aaaagguaaugccugaacaaguu

SEQ ID NO: 2198 - RNA, 22 nt, Artificial Sequence
  Synthetic
aaagguaaugccugaacaaguu

SEQ ID NO: 2199 - RNA, 21 nt, Artificial Sequence
  Synthetic
aagguaaugccugaacaaguu

SEQ ID NO: 2200 - RNA, 20 nt, Artificial Sequence
  Synthetic
agguaaugccugaacaaguu

SEQ ID NO: 2201 - RNA, 19 nt, Artificial Sequence
  Synthetic
acgugcucuuuucuauaua

SEQ ID NO: 2202 - RNA, 23 nt, Artificial Sequence
  Synthetic
auuaucuauuccauucuucacac

SEQ ID NO: 2203 - RNA, 20 nt, Artificial Sequence
  Synthetic
aucuauuccauucuucacac

SEQ ID NO: 2204 - RNA, 24 nt, Artificial Sequence
  Synthetic
aagagagaaaugguucccuauaua

SEQ ID NO: 2205 - RNA, 23 nt, Artificial Sequence
  Synthetic
agagagaaaugguucccuauaua

SEQ ID NO: 2206 - RNA, 21 nt, Artificial Sequence
  Synthetic
agagaaaugguucccuauaua

SEQ ID NO: 2207 - RNA, 19 nt, Artificial Sequence
  Synthetic
agaaaugguucccuauaua

SEQ ID NO: 2208 - RNA, 19 nt, Artificial Sequence
  Synthetic
aggaaauuauuguugcuuu

SEQ ID NO: 2209 - RNA, 22 nt, Artificial Sequence
  Synthetic
acugagcaaaacaacuggaaga

SEQ ID NO: 2210 - RNA, 18 nt, Artificial Sequence
  Synthetic
agcaaaacaacuggaaga

SEQ ID NO: 2211 - RNA, 24 nt, Artificial Sequence
  Synthetic
auacauaagaaagaacacuguggu

SEQ ID NO: 2212 - RNA, 22 nt, Artificial Sequence
  Synthetic
acauaagaaagaacacuguggu

SEQ ID NO: 2213 - RNA, 20 nt, Artificial Sequence
  Synthetic
auaagaaagaacacuguggu

SEQ ID NO: 2214 - RNA, 18 nt, Artificial Sequence
  Synthetic
aagaaagaacacuguggu

SEQ ID NO: 2215 - RNA, 18 nt, Artificial Sequence
  Synthetic
aagaauggaauagauaau

SEQ ID NO: 2216 - RNA, 22 nt, Artificial Sequence
  Synthetic
aaggaggauguaagacuggaga

SEQ ID NO: 2217 - RNA, 21 nt, Artificial Sequence
  Synthetic
aggaggauguaagacuggaga

SEQ ID NO: 2218 - RNA, 18 nt, Artificial Sequence
  Synthetic
aggauguaagacuggaga

SEQ ID NO: 2219 - RNA, 23 nt, Artificial Sequence
  Synthetic
aaaaacuugaaauuugauaguag

SEQ ID NO: 2220 - RNA, 22 nt, Artificial Sequence
  Synthetic
aaaacuugaaauuugauaguag

SEQ ID NO: 2221 - RNA, 21 nt, Artificial Sequence
  Synthetic
aaacuugaaauuugauaguag

SEQ ID NO: 2222 - RNA, 20 nt, Artificial Sequence
  Synthetic
aacuugaaauuugauaguag

SEQ ID NO: 2223 - RNA, 19 nt, Artificial Sequence
  Synthetic
acuugaaauuugauaguag

SEQ ID NO: 2224 - RNA, 18 nt, Artificial Sequence
  Synthetic
acauaucugucuuccuua

SEQ ID NO: 2225 - RNA, 18 nt, Artificial Sequence
  Synthetic
auuaaaaaaaguaugcuu

SEQ ID NO: 2226 - RNA, 24 nt, Artificial Sequence
  Synthetic
auaucaaaagacuuauauuccauu

SEQ ID NO: 2227 - RNA, 22 nt, Artificial Sequence
  Synthetic
aucaaaagacuuauauuccauu

SEQ ID NO: 2228 - RNA, 19 nt, Artificial Sequence
  Synthetic
aaaagacuuauauuccauu

SEQ ID NO: 2229 - RNA, 18 nt, Artificial Sequence
  Synthetic
aaagacuuauauuccauu

SEQ ID NO: 2230 - RNA, 24 nt, Artificial Sequence
  Synthetic
aaaaucagauuucaugugugaaga

SEQ ID NO: 2231 - RNA, 23 nt, Artificial Sequence
  Synthetic
aaaucagauuucaugugugaaga

SEQ ID NO: 2232 - RNA, 22 nt, Artificial Sequence
  Synthetic
aaucagauuucaugugugaaga

SEQ ID NO: 2233 - RNA, 21 nt, Artificial Sequence
  Synthetic
aucagauuucaugugugaaga

SEQ ID NO: 2234 - RNA, 18 nt, Artificial Sequence
  Synthetic
agauuucaugugugaaga

SEQ ID NO: 2235 - RNA, 24 nt, Artificial Sequence
  Synthetic
aauggaauauaagucuuuugauau

SEQ ID NO: 2236 - RNA, 23 nt, Artificial Sequence
  Synthetic
auggaauauaagucuuuugauau

SEQ ID NO: 2237 - RNA, 19 nt, Artificial Sequence
  Synthetic
aauauaagucuuuugauau

SEQ ID NO: 2238 - RNA, 18 nt, Artificial Sequence
  Synthetic
auauaagucuuuugauau

SEQ ID NO: 2239 - RNA, 19 nt, Artificial Sequence
  Synthetic
aagaauggaauagauaaua

SEQ ID NO: 2240 - RNA, 18 nt, Artificial Sequence
  Synthetic
agaauggaauagauaaua

SEQ ID NO: 2241 - RNA, 24 nt, Artificial Sequence
  Synthetic
aaaacuggauggguaauaaagcaa

SEQ ID NO: 2242 - RNA, 23 nt, Artificial Sequence
  Synthetic
aaacuggauggguaauaaagcaa

SEQ ID NO: 2243 - RNA, 22 nt, Artificial Sequence
  Synthetic
aacuggauggguaauaaagcaa

SEQ ID NO: 2244 - RNA, 21 nt, Artificial Sequence
  Synthetic
acuggauggguaauaaagcaa

SEQ ID NO: 2245 - RNA, 24 nt, Artificial Sequence
  Synthetic
auagaaauucacugagcaaaacaa

SEQ ID NO: 2246 - RNA, 22 nt, Artificial Sequence
  Synthetic
agaaauucacugagcaaaacaa

SEQ ID NO: 2247 - RNA, 20 nt, Artificial Sequence
  Synthetic
aaauucacugagcaaaacaa

SEQ ID NO: 2248 - RNA, 19 nt, Artificial Sequence
  Synthetic
aauucacugagcaaaacaa

SEQ ID NO: 2249 - RNA, 18 nt, Artificial Sequence
  Synthetic
auucacugagcaaaacaa

SEQ ID NO: 2250 - RNA, 24 nt, Artificial Sequence
  Synthetic
aggauguaagacuggagauagaga

SEQ ID NO: 2251 - RNA, 21 nt, Artificial Sequence
  Synthetic
auguaagacuggagauagaga

SEQ ID NO: 2252 - RNA, 21 nt, Artificial Sequence
  Synthetic
aaauuugauaguagaagaaaa

SEQ ID NO: 2253 - RNA, 20 nt, Artificial Sequence
  Synthetic
aauuugauaguagaagaaaa

SEQ ID NO: 2254 - RNA, 19 nt, Artificial Sequence
  Synthetic
auuugauaguagaagaaaa

SEQ ID NO: 2255 - RNA, 24 nt, Artificial Sequence
  Synthetic
aaaauaaaacuaagacacugccaa

SEQ ID NO: 2256 - RNA, 23 nt, Artificial Sequence
  Synthetic
aaauaaaacuaagacacugccaa

SEQ ID NO: 2257 - RNA, 22 nt, Artificial Sequence
  Synthetic
aauaaaacuaagacacugccaa

SEQ ID NO: 2258 - RNA, 21 nt, Artificial Sequence
  Synthetic
auaaaacuaagacacugccaa

SEQ ID NO: 2259 - RNA, 19 nt, Artificial Sequence
  Synthetic
aaaacuaagacacugccaa

SEQ ID NO: 2260 - RNA, 18 nt, Artificial Sequence
  Synthetic
aaacuaagacacugccaa

SEQ ID NO: 2261 - RNA, 19 nt, Artificial Sequence
  Synthetic
aauaaagcaaaagaaaaac

SEQ ID NO: 2262 - RNA, 18 nt, Artificial Sequence
  Synthetic
auaaagcaaaagaaaaac

SEQ ID NO: 2263 - RNA, 24 nt, Artificial Sequence
  Synthetic
auucuuuuuuuguuguuuuuuuuu

SEQ ID NO: 2264 - RNA, 20 nt, Artificial Sequence
  Synthetic
acuccagccugggcaacaca

SEQ ID NO: 2265 - RNA, 22 nt, Artificial Sequence
  Synthetic
cuuaccucaugucaucuagagc

SEQ ID NO: 2266 - RNA, 18 nt, Artificial Sequence
  Synthetic
ccucaugucaucuagagc

SEQ ID NO: 2267 - RNA, 23 nt, Artificial Sequence
  Synthetic
caguuuuuaaggcggggagucac

SEQ ID NO: 2268 - RNA, 20 nt, Artificial Sequence
  Synthetic
cacagaguucaagcuaauac

SEQ ID NO: 2269 - RNA, 18 nt, Artificial Sequence
  Synthetic
cagaguucaagcuaauac

SEQ ID NO: 2270 - RNA, 19 nt, Artificial Sequence
  Synthetic
cuugaacucugugccaaac

SEQ ID NO: 2271 - RNA, 23 nt, Artificial Sequence
  Synthetic
cauguggugucaaauauggugcu

SEQ ID NO: 2272 - RNA, 24 nt, Artificial Sequence
  Synthetic
cauguggugucaaauauggugcuu

SEQ ID NO: 2273 - RNA, 22 nt, Artificial Sequence
  Synthetic
cucuagaugacaugagguaagu

SEQ ID NO: 2274 - RNA, 20 nt, Artificial Sequence
  Synthetic
cuagaugacaugagguaagu

SEQ ID NO: 2275 - RNA, 24 nt, Artificial Sequence
  Synthetic
cuaauacaugagagugauuagugg

SEQ ID NO: 2276 - RNA, 18 nt, Artificial Sequence
  Synthetic
caugagagugauuagugg

SEQ ID NO: 2277 - RNA, 18 nt, Artificial Sequence
  Synthetic
cugccaauagggauaggu

SEQ ID NO: 2278 - RNA, 23 nt, Artificial Sequence
  Synthetic
ccaaacaggagauacucaacaca

SEQ ID NO: 2279 - RNA, 22 nt, Artificial Sequence
  Synthetic
caaacaggagauacucaacaca

SEQ ID NO: 2280 - RNA, 18 nt, Artificial Sequence
  Synthetic
caggagauacucaacaca

SEQ ID NO: 2281 - RNA, 21 nt, Artificial Sequence
  Synthetic
cacguacaaaagaacauacau

SEQ ID NO: 2282 - RNA, 19 nt, Artificial Sequence
  Synthetic
cguacaaaagaacauacau

SEQ ID NO: 2283 - RNA, 20 nt, Artificial Sequence
  Synthetic
caguaaggaggauguaagac

SEQ ID NO: 2284 - RNA, 19 nt, Artificial Sequence
  Synthetic
cuuuugacaguuuuuaagg

SEQ ID NO: 2285 - RNA, 19 nt, Artificial Sequence
  Synthetic
cgugcucuuuucuauauau

SEQ ID NO: 2286 - RNA, 19 nt, Artificial Sequence
  Synthetic
cacugagcaaaacaacugg

SEQ ID NO: 2287 - RNA, 24 nt, Artificial Sequence
  Synthetic
ccugaacaaguuuugaaacaggaa

SEQ ID NO: 2288 - RNA, 23 nt, Artificial Sequence
  Synthetic
cugaacaaguuuugaaacaggaa

SEQ ID NO: 2289 - RNA, 18 nt, Artificial Sequence
  Synthetic
caaguuuugaaacaggaa

SEQ ID NO: 2290 - RNA, 18 nt, Artificial Sequence
  Synthetic
ccugaacaaguuuugaaa

SEQ ID NO: 2291 - RNA, 21 nt, Artificial Sequence
  Synthetic
cacugagcaaaacaacuggaa

SEQ ID NO: 2292 - RNA, 19 nt, Artificial Sequence
  Synthetic
cugagcaaaacaacuggaa

SEQ ID NO: 2293 - RNA, 18 nt, Artificial Sequence
  Synthetic
cgugcucuuuucuauaua

SEQ ID NO: 2294 - RNA, 18 nt, Artificial Sequence
  Synthetic
cuauuccauucuucacac

SEQ ID NO: 2295 - RNA, 22 nt, Artificial Sequence
  Synthetic
cuuaggaaauuauuguugcuuu

SEQ ID NO: 2296 - RNA, 21 nt, Artificial Sequence
  Synthetic
cuuuuugagagguaaagguuc

SEQ ID NO: 2297 - RNA, 23 nt, Artificial Sequence
  Synthetic
cacugagcaaaacaacuggaaga

SEQ ID NO: 2298 - RNA, 21 nt, Artificial Sequence
  Synthetic
cugagcaaaacaacuggaaga

SEQ ID NO: 2299 - RNA, 21 nt, Artificial Sequence
  Synthetic
cauaagaaagaacacuguggu

SEQ ID NO: 2300 - RNA, 18 nt, Artificial Sequence
  Synthetic
cuugaaauuugauaguag

SEQ ID NO: 2301 - RNA, 20 nt, Artificial Sequence
  Synthetic
ccauuaaaaaaaguaugcuu

SEQ ID NO: 2302 - RNA, 19 nt, Artificial Sequence
  Synthetic
cauuaaaaaaaguaugcuu

SEQ ID NO: 2303 - RNA, 20 nt, Artificial Sequence
  Synthetic
caaaagacuuauauuccauu

SEQ ID NO: 2304 - RNA, 19 nt, Artificial Sequence
  Synthetic
cagauuucaugugugaaga

SEQ ID NO: 2305 - RNA, 20 nt, Artificial Sequence
  Synthetic
cuggauggguaauaaagcaa

SEQ ID NO: 2306 - RNA, 19 nt, Artificial Sequence
  Synthetic
cuuaagcauacuuuuuuua

SEQ ID NO: 2307 - RNA, 21 nt, Artificial Sequence
  Synthetic
cuuuuuuuguuguuuuuuuuu

SEQ ID NO: 2308 - RNA, 24 nt, Artificial Sequence
  Synthetic
cugcacuccagccugggcaacaca

SEQ ID NO: 2309 - RNA, 21 nt, Artificial Sequence
  Synthetic
cacuccagccugggcaacaca

SEQ ID NO: 2310 - RNA, 19 nt, Artificial Sequence
  Synthetic
cuccagccugggcaacaca

SEQ ID NO: 2311 - RNA, 21 nt, Artificial Sequence
  Synthetic
guuuuuaaggcggggagucac

SEQ ID NO: 2312 - RNA, 22 nt, Artificial Sequence
  Synthetic
ggcacagaguucaagcuaauac

SEQ ID NO: 2313 - RNA, 21 nt, Artificial Sequence
  Synthetic
gcacagaguucaagcuaauac

SEQ ID NO: 2314 - RNA, 24 nt, Artificial Sequence
  Synthetic
gcauguggugucaaauauggugcu

SEQ ID NO: 2315 - RNA, 20 nt, Artificial Sequence
  Synthetic
guggugucaaauauggugcu

SEQ ID NO: 2316 - RNA, 18 nt, Artificial Sequence
  Synthetic
ggugucaaauauggugcu

SEQ ID NO: 2317 - RNA, 21 nt, Artificial Sequence
  Synthetic
guggugucaaauauggugcuu

SEQ ID NO: 2318 - RNA, 19 nt, Artificial Sequence
  Synthetic
ggugucaaauauggugcuu

SEQ ID NO: 2319 - RNA, 18 nt, Artificial Sequence
  Synthetic
gugucaaauauggugcuu

SEQ ID NO: 2320 - RNA, 23 nt, Artificial Sequence
  Synthetic
gcucuagaugacaugagguaagu

SEQ ID NO: 2321 - RNA, 22 nt, Artificial Sequence
  Synthetic
gacacugccaauagggauaggu

SEQ ID NO: 2322 - RNA, 20 nt, Artificial Sequence
  Synthetic
gguucaugagacuagagguc

SEQ ID NO: 2323 - RNA, 19 nt, Artificial Sequence
  Synthetic
guucaugagacuagagguc

SEQ ID NO: 2324 - RNA, 24 nt, Artificial Sequence
  Synthetic
gccaaacaggagauacucaacaca

SEQ ID NO: 2325 - RNA, 24 nt, Artificial Sequence
  Synthetic
gagcacguacaaaagaacauacau

SEQ ID NO: 2326 - RNA, 22 nt, Artificial Sequence
  Synthetic
gcacguacaaaagaacauacau

SEQ ID NO: 2327 - RNA, 18 nt, Artificial Sequence
  Synthetic
guacaaaagaacauacau

SEQ ID NO: 2328 - RNA, 24 nt, Artificial Sequence
  Synthetic
guggcaguaaggaggauguaagac

SEQ ID NO: 2329 - RNA, 22 nt, Artificial Sequence
  Synthetic
ggcaguaaggaggauguaagac

SEQ ID NO: 2330 - RNA, 21 nt, Artificial Sequence
  Synthetic
gcaguaaggaggauguaagac

SEQ ID NO: 2331 - RNA, 18 nt, Artificial Sequence
  Synthetic
guaaggaggauguaagac

SEQ ID NO: 2332 - RNA, 24 nt, Artificial Sequence
  Synthetic
gguagcuuuugacaguuuuuaagg

SEQ ID NO: 2333 - RNA, 23 nt, Artificial Sequence
  Synthetic
guagcuuuugacaguuuuuaagg

SEQ ID NO: 2334 - RNA, 22 nt, Artificial Sequence
  Synthetic
guacgugcucuuuucuauauau

SEQ ID NO: 2335 - RNA, 18 nt, Artificial Sequence
  Synthetic
gugcucuuuucuauauau

SEQ ID NO: 2336 - RNA, 21 nt, Artificial Sequence
  Synthetic
gaacaaguuuugaaacaggaa

SEQ ID NO: 2337 - RNA, 24 nt, Artificial Sequence
  Synthetic
guaaugccugaacaaguuuugaaa

SEQ ID NO: 2338 - RNA, 19 nt, Artificial Sequence
  Synthetic
gccugaacaaguuuugaaa

SEQ ID NO: 2339 - RNA, 19 nt, Artificial Sequence
  Synthetic
gguaaugccugaacaaguu

SEQ ID NO: 2340 - RNA, 18 nt, Artificial Sequence
  Synthetic
guaaugccugaacaaguu

SEQ ID NO: 2341 - RNA, 21 nt, Artificial Sequence
  Synthetic
guacgugcucuuuucuauaua

SEQ ID NO: 2342 - RNA, 22 nt, Artificial Sequence
  Synthetic
gagagaaaugguucccuauaua

SEQ ID NO: 2343 - RNA, 20 nt, Artificial Sequence
  Synthetic
gagaaaugguucccuauaua

SEQ ID NO: 2344 - RNA, 18 nt, Artificial Sequence
  Synthetic
gaaaugguucccuauaua

SEQ ID NO: 2345 - RNA, 23 nt, Artificial Sequence
  Synthetic
gcuuaggaaauuauuguugcuuu

SEQ ID NO: 2346 - RNA, 18 nt, Artificial Sequence
  Synthetic
ggaaauuauuguugcuuu

SEQ ID NO: 2347 - RNA, 22 nt, Artificial Sequence
  Synthetic
gcuuuuugagagguaaagguuc

SEQ ID NO: 2348 - RNA, 19 nt, Artificial Sequence
  Synthetic
gagcaaaacaacuggaaga

SEQ ID NO: 2349 - RNA, 23 nt, Artificial Sequence
  Synthetic
gugugaagaauggaauagauaau

SEQ ID NO: 2350 - RNA, 21 nt, Artificial Sequence
  Synthetic
gugaagaauggaauagauaau

SEQ ID NO: 2351 - RNA, 19 nt, Artificial Sequence
  Synthetic
gaagaauggaauagauaau

SEQ ID NO: 2352 - RNA, 24 nt, Artificial Sequence
  Synthetic
guaaggaggauguaagacuggaga

SEQ ID NO: 2353 - RNA, 20 nt, Artificial Sequence
  Synthetic
ggaggauguaagacuggaga

SEQ ID NO: 2354 - RNA, 19 nt, Artificial Sequence
  Synthetic
gaggauguaagacuggaga

SEQ ID NO: 2355 - RNA, 24 nt, Artificial Sequence
  Synthetic
gaaaaacuugaaauuugauaguag

SEQ ID NO: 2356 - RNA, 24 nt, Artificial Sequence
  Synthetic
guguuuacauaucugucuuccuua

SEQ ID NO: 2357 - RNA, 22 nt, Artificial Sequence
  Synthetic
guuuacauaucugucuuccuua

SEQ ID NO: 2358 - RNA, 23 nt, Artificial Sequence
  Synthetic
guuccauuaaaaaaaguaugcuu

SEQ ID NO: 2359 - RNA, 21 nt, Artificial Sequence
  Synthetic
ggaauauaagucuuuugauau

SEQ ID NO: 2360 - RNA, 20 nt, Artificial Sequence
  Synthetic
gaauauaagucuuuugauau

SEQ ID NO: 2361 - RNA, 24 nt, Artificial Sequence
  Synthetic
gugugaagaauggaauagauaaua

SEQ ID NO: 2362 - RNA, 22 nt, Artificial Sequence
  Synthetic
gugaagaauggaauagauaaua

SEQ ID NO: 2363 - RNA, 18 nt, Artificial Sequence
  Synthetic
ggauggguaauaaagcaa

SEQ ID NO: 2364 - RNA, 21 nt, Artificial Sequence
  Synthetic
gaaauucacugagcaaaacaa

SEQ ID NO: 2365 - RNA, 23 nt, Artificial Sequence
  Synthetic
ggauguaagacuggagauagaga

SEQ ID NO: 2366 - RNA, 22 nt, Artificial Sequence
  Synthetic
gauguaagacuggagauagaga

SEQ ID NO: 2367 - RNA, 19 nt, Artificial Sequence
  Synthetic
guaagacuggagauagaga

SEQ ID NO: 2368 - RNA, 22 nt, Artificial Sequence
  Synthetic
gaaauuugauaguagaagaaaa

SEQ ID NO: 2369 - RNA, 23 nt, Artificial Sequence
  Synthetic
ggguaauaaagcaaaagaaaaac

SEQ ID NO: 2370 - RNA, 22 nt, Artificial Sequence
  Synthetic
gguaauaaagcaaaagaaaaac

SEQ ID NO: 2371 - RNA, 21 nt, Artificial Sequence
  Synthetic
guaauaaagcaaaagaaaaac

SEQ ID NO: 2372 - RNA, 22 nt, Artificial Sequence
  Synthetic
gcacuccagccugggcaacaca

SEQ ID NO: 2373 - RNA, 24 nt, Artificial Sequence
  Synthetic
uacuuaccucaugucaucuagagc

SEQ ID NO: 2374 - RNA, 21 nt, Artificial Sequence
  Synthetic
uuaccucaugucaucuagagc

SEQ ID NO: 2375 - RNA, 20 nt, Artificial Sequence
  Synthetic
uaccucaugucaucuagagc

SEQ ID NO: 2376 - RNA, 20 nt, Artificial Sequence
  Synthetic
uuuuuaaggcggggagucac

SEQ ID NO: 2377 - RNA, 19 nt, Artificial Sequence
  Synthetic
uuuuaaggcggggagucac

SEQ ID NO: 2378 - RNA, 18 nt, Artificial Sequence
  Synthetic
uuuaaggcggggagucac

SEQ ID NO: 2379 - RNA, 24 nt, Artificial Sequence
  Synthetic
uuggcacagaguucaagcuaauac

SEQ ID NO: 2380 - RNA, 23 nt, Artificial Sequence
  Synthetic
uggcacagaguucaagcuaauac

SEQ ID NO: 2381 - RNA, 23 nt, Artificial Sequence
  Synthetic
uuagcuugaacucugugccaaac

SEQ ID NO: 2382 - RNA, 22 nt, Artificial Sequence
  Synthetic
uagcuugaacucugugccaaac

SEQ ID NO: 2383 - RNA, 18 nt, Artificial Sequence
  Synthetic
uugaacucugugccaaac

SEQ ID NO: 2384 - RNA, 21 nt, Artificial Sequence
  Synthetic
uguggugucaaauauggugcu

SEQ ID NO: 2385 - RNA, 19 nt, Artificial Sequence
  Synthetic
uggugucaaauauggugcu

SEQ ID NO: 2386 - RNA, 22 nt, Artificial Sequence
  Synthetic
uguggugucaaauauggugcuu

SEQ ID NO: 2387 - RNA, 20 nt, Artificial Sequence
  Synthetic
uggugucaaauauggugcuu

SEQ ID NO: 2388 - RNA, 24 nt, Artificial Sequence
  Synthetic
ugcucuagaugacaugagguaagu

SEQ ID NO: 2389 - RNA, 21 nt, Artificial Sequence
  Synthetic
ucuagaugacaugagguaagu

SEQ ID NO: 2390 - RNA, 19 nt, Artificial Sequence
  Synthetic
uagaugacaugagguaagu

SEQ ID NO: 2391 - RNA, 23 nt, Artificial Sequence
  Synthetic
uaauacaugagagugauuagugg

SEQ ID NO: 2392 - RNA, 24 nt, Artificial Sequence
  Synthetic
uaaagguucaugagacuagagguc

SEQ ID NO: 2393 - RNA, 18 nt, Artificial Sequence
  Synthetic
uucaugagacuagagguc

SEQ ID NO: 2394 - RNA, 23 nt, Artificial Sequence
  Synthetic
uggcaguaaggaggauguaagac

SEQ ID NO: 2395 - RNA, 22 nt, Artificial Sequence
  Synthetic
uagcuuuugacaguuuuuaagg

SEQ ID NO: 2396 - RNA, 18 nt, Artificial Sequence
  Synthetic
uuuugacaguuuuuaagg

SEQ ID NO: 2397 - RNA, 24 nt, Artificial Sequence
  Synthetic
uuguacgugcucuuuucuauauau

SEQ ID NO: 2398 - RNA, 23 nt, Artificial Sequence
  Synthetic
uguacgugcucuuuucuauauau

SEQ ID NO: 2399 - RNA, 21 nt, Artificial Sequence
  Synthetic
uacgugcucuuuucuauauau

SEQ ID NO: 2400 - RNA, 21 nt, Artificial Sequence
  Synthetic
uucacugagcaaaacaacugg

SEQ ID NO: 2401 - RNA, 20 nt, Artificial Sequence
  Synthetic
ucacugagcaaaacaacugg

SEQ ID NO: 2402 - RNA, 22 nt, Artificial Sequence
  Synthetic
ugaacaaguuuugaaacaggaa

SEQ ID NO: 2403 - RNA, 23 nt, Artificial Sequence
  Synthetic
uaaugccugaacaaguuuugaaa

SEQ ID NO: 2404 - RNA, 20 nt, Artificial Sequence
  Synthetic
ugccugaacaaguuuugaaa

SEQ ID NO: 2405 - RNA, 23 nt, Artificial Sequence
  Synthetic
uucacugagcaaaacaacuggaa

SEQ ID NO: 2406 - RNA, 22 nt, Artificial Sequence
  Synthetic
ucacugagcaaaacaacuggaa

SEQ ID NO: 2407 - RNA, 18 nt, Artificial Sequence
  Synthetic
ugagcaaaacaacuggaa

SEQ ID NO: 2408 - RNA, 24 nt, Artificial Sequence
  Synthetic
uuuguacgugcucuuuucuauaua

SEQ ID NO: 2409 - RNA, 23 nt, Artificial Sequence
  Synthetic
uuguacgugcucuuuucuauaua

SEQ ID NO: 2410 - RNA, 22 nt, Artificial Sequence
  Synthetic
uguacgugcucuuuucuauaua

SEQ ID NO: 2411 - RNA, 20 nt, Artificial Sequence
  Synthetic
uacgugcucuuuucuauaua

SEQ ID NO: 2412 - RNA, 24 nt, Artificial Sequence
  Synthetic
uauuaucuauuccauucuucacac

SEQ ID NO: 2413 - RNA, 22 nt, Artificial Sequence
  Synthetic
uuaucuauuccauucuucacac

SEQ ID NO: 2414 - RNA, 21 nt, Artificial Sequence
  Synthetic
uaucuauuccauucuucacac

SEQ ID NO: 2415 - RNA, 19 nt, Artificial Sequence
  Synthetic
ucuauuccauucuucacac

SEQ ID NO: 2416 - RNA, 24 nt, Artificial Sequence
  Synthetic
ugcuuaggaaauuauuguugcuuu

SEQ ID NO: 2417 - RNA, 21 nt, Artificial Sequence
  Synthetic
uuaggaaauuauuguugcuuu

SEQ ID NO: 2418 - RNA, 20 nt, Artificial Sequence
  Synthetic
uaggaaauuauuguugcuuu

SEQ ID NO: 2419 - RNA, 24 nt, Artificial Sequence
  Synthetic
uugcuuuuugagagguaaagguuc

SEQ ID NO: 2420 - RNA, 23 nt, Artificial Sequence
  Synthetic
ugcuuuuugagagguaaagguuc

SEQ ID NO: 2421 - RNA, 20 nt, Artificial Sequence
  Synthetic
uuuuugagagguaaagguuc

SEQ ID NO: 2422 - RNA, 19 nt, Artificial Sequence
  Synthetic
uuuugagagguaaagguuc

SEQ ID NO: 2423 - RNA, 18 nt, Artificial Sequence
  Synthetic
uuugagagguaaagguuc

SEQ ID NO: 2424 - RNA, 24 nt, Artificial Sequence
  Synthetic
ucacugagcaaaacaacuggaaga

SEQ ID NO: 2425 - RNA, 20 nt, Artificial Sequence
  Synthetic
ugagcaaaacaacuggaaga

SEQ ID NO: 2426 - RNA, 23 nt, Artificial Sequence
  Synthetic
uacauaagaaagaacacuguggu

SEQ ID NO: 2427 - RNA, 19 nt, Artificial Sequence
  Synthetic
uaagaaagaacacuguggu

SEQ ID NO: 2428 - RNA, 24 nt, Artificial Sequence
  Synthetic
ugugugaagaauggaauagauaau

SEQ ID NO: 2429 - RNA, 22 nt, Artificial Sequence
  Synthetic
ugugaagaauggaauagauaau

SEQ ID NO: 2430 - RNA, 20 nt, Artificial Sequence
  Synthetic
ugaagaauggaauagauaau

SEQ ID NO: 2431 - RNA, 23 nt, Artificial Sequence
  Synthetic
uaaggaggauguaagacuggaga

SEQ ID NO: 2432 - RNA, 23 nt, Artificial Sequence
  Synthetic
uguuuacauaucugucuuccuua

SEQ ID NO: 2433 - RNA, 21 nt, Artificial Sequence
  Synthetic
uuuacauaucugucuuccuua

SEQ ID NO: 2434 - RNA, 20 nt, Artificial Sequence
  Synthetic
uuacauaucugucuuccuua

SEQ ID NO: 2435 - RNA, 19 nt, Artificial Sequence
  Synthetic
uacauaucugucuuccuua

SEQ ID NO: 2436 - RNA, 24 nt, Artificial Sequence
  Synthetic
uguuccauuaaaaaaaguaugcuu

SEQ ID NO: 2437 - RNA, 22 nt, Artificial Sequence
  Synthetic
uuccauuaaaaaaaguaugcuu

SEQ ID NO: 2438 - RNA, 21 nt, Artificial Sequence
  Synthetic
uccauuaaaaaaaguaugcuu

SEQ ID NO: 2439 - RNA, 23 nt, Artificial Sequence
  Synthetic
uaucaaaagacuuauauuccauu

SEQ ID NO: 2440 - RNA, 21 nt, Artificial Sequence
  Synthetic
ucaaaagacuuauauuccauu

SEQ ID NO: 2441 - RNA, 20 nt, Artificial Sequence
  Synthetic
ucagauuucaugugugaaga

SEQ ID NO: 2442 - RNA, 22 nt, Artificial Sequence
  Synthetic
uggaauauaagucuuuugauau

SEQ ID NO: 2443 - RNA, 23 nt, Artificial Sequence
  Synthetic
ugugaagaauggaauagauaaua

SEQ ID NO: 2444 - RNA, 21 nt, Artificial Sequence
  Synthetic
ugaagaauggaauagauaaua

SEQ ID NO: 2445 - RNA, 19 nt, Artificial Sequence
  Synthetic
uggauggguaauaaagcaa

SEQ ID NO: 2446 - RNA, 23 nt, Artificial Sequence
  Synthetic
uagaaauucacugagcaaaacaa

SEQ ID NO: 2447 - RNA, 20 nt, Artificial Sequence
  Synthetic
uguaagacuggagauagaga

SEQ ID NO: 2448 - RNA, 18 nt, Artificial Sequence
  Synthetic
uaagacuggagauagaga

SEQ ID NO: 2449 - RNA, 24 nt, Artificial Sequence
  Synthetic
uugaaauuugauaguagaagaaaa

SEQ ID NO: 2450 - RNA, 23 nt, Artificial Sequence
  Synthetic
ugaaauuugauaguagaagaaaa

SEQ ID NO: 2451 - RNA, 18 nt, Artificial Sequence
  Synthetic
uuugauaguagaagaaaa

SEQ ID NO: 2452 - RNA, 20 nt, Artificial Sequence
  Synthetic
uaaaacuaagacacugccaa

SEQ ID NO: 2453 - RNA, 24 nt, Artificial Sequence
  Synthetic
uuuuucuuaagcauacuuuuuuua

SEQ ID NO: 2454 - RNA, 23 nt, Artificial Sequence
  Synthetic
uuuucuuaagcauacuuuuuuua

SEQ ID NO: 2455 - RNA, 22 nt, Artificial Sequence
  Synthetic
uuucuuaagcauacuuuuuuua

SEQ ID NO: 2456 - RNA, 21 nt, Artificial Sequence
  Synthetic
uucuuaagcauacuuuuuuua

SEQ ID NO: 2457 - RNA, 20 nt, Artificial Sequence
  Synthetic
ucuuaagcauacuuuuuuua

SEQ ID NO: 2458 - RNA, 18 nt, Artificial Sequence
  Synthetic
uuaagcauacuuuuuuua

SEQ ID NO: 2459 - RNA, 24 nt, Artificial Sequence
  Synthetic
uggguaauaaagcaaaagaaaaac

SEQ ID NO: 2460 - RNA, 20 nt, Artificial Sequence
  Synthetic
uaauaaagcaaaagaaaaac

SEQ ID NO: 2461 - RNA, 23 nt, Artificial Sequence
  Synthetic
uucuuuuuuuguuguuuuuuuuu

SEQ ID NO: 2462 - RNA, 22 nt, Artificial Sequence
  Synthetic
ucuuuuuuuguuguuuuuuuuu

SEQ ID NO: 2463 - RNA, 20 nt, Artificial Sequence
  Synthetic
uuuuuuuguuguuuuuuuuu

SEQ ID NO: 2464 - RNA, 19 nt, Artificial Sequence
  Synthetic
uuuuuuguuguuuuuuuuu

SEQ ID NO: 2465 - RNA, 18 nt, Artificial Sequence
  Synthetic
uuuuuguuguuuuuuuuu

SEQ ID NO: 2466 - RNA, 23 nt, Artificial Sequence
  Synthetic
ugcacuccagccugggcaacaca

SEQ ID NO: 2467 - RNA, 18 nt, Artificial Sequence
  Synthetic
uccagccugggcaacaca

SEQ ID NO: 2468 - RNA, 21 nt, Artificial Sequence
  Synthetic
auuuucgugaccucuagucuc

SEQ ID NO: 2469 - RNA, 23 nt, Artificial Sequence
  Synthetic
acuaaucacucucauguauuagc

SEQ ID NO: 2470 - RNA, 20 nt, Artificial Sequence
  Synthetic
aaucacucucauguauuagc

SEQ ID NO: 2471 - RNA, 19 nt, Artificial Sequence
  Synthetic
aucacucucauguauuagc

SEQ ID NO: 2472 - RNA, 19 nt, Artificial Sequence
  Synthetic
agaugacaugagguaagua

SEQ ID NO: 2473 - RNA, 24 nt, Artificial Sequence
  Synthetic
accucaugucaucuagagcaagag

SEQ ID NO: 2474 - RNA, 19 nt, Artificial Sequence
  Synthetic
augucaucuagagcaagag

SEQ ID NO: 2475 - RNA, 24 nt, Artificial Sequence
  Synthetic
aauacaugagagugauuaguggug

SEQ ID NO: 2476 - RNA, 23 nt, Artificial Sequence
  Synthetic
auacaugagagugauuaguggug

SEQ ID NO: 2477 - RNA, 21 nt, Artificial Sequence
  Synthetic
acaugagagugauuaguggug

SEQ ID NO: 2478 - RNA, 19 nt, Artificial Sequence
  Synthetic
augagagugauuaguggug

SEQ ID NO: 2479 - RNA, 21 nt, Artificial Sequence
  Synthetic
acgugcucuuuucuauauaua

SEQ ID NO: 2480 - RNA, 21 nt, Artificial Sequence
  Synthetic
acaaaaccuauguauaagaug

SEQ ID NO: 2481 - RNA, 19 nt, Artificial Sequence
  Synthetic
aaaaccuauguauaagaug

SEQ ID NO: 2482 - RNA, 18 nt, Artificial Sequence
  Synthetic
aaaccuauguauaagaug

SEQ ID NO: 2483 - RNA, 24 nt, Artificial Sequence
  Synthetic
auauauagaaaagagcacguacaa

SEQ ID NO: 2484 - RNA, 22 nt, Artificial Sequence
  Synthetic
auauagaaaagagcacguacaa

SEQ ID NO: 2485 - RNA, 20 nt, Artificial Sequence
  Synthetic
auagaaaagagcacguacaa

SEQ ID NO: 2486 - RNA, 18 nt, Artificial Sequence
  Synthetic
agaaaagagcacguacaa

SEQ ID NO: 2487 - RNA, 24 nt, Artificial Sequence
  Synthetic
agaaaugguucccuauauauagaa

SEQ ID NO: 2488 - RNA, 22 nt, Artificial Sequence
  Synthetic
aaaugguucccuauauauagaa

SEQ ID NO: 2489 - RNA, 21 nt, Artificial Sequence
  Synthetic
aaugguucccuauauauagaa

SEQ ID NO: 2490 - RNA, 20 nt, Artificial Sequence
  Synthetic
augguucccuauauauagaa

SEQ ID NO: 2491 - RNA, 24 nt, Artificial Sequence
  Synthetic
auggaauauaagucuuuugauaua

SEQ ID NO: 2492 - RNA, 20 nt, Artificial Sequence
  Synthetic
aauauaagucuuuugauaua

SEQ ID NO: 2493 - RNA, 19 nt, Artificial Sequence
  Synthetic
auauaagucuuuugauaua

SEQ ID NO: 2494 - RNA, 24 nt, Artificial Sequence
  Synthetic
acguacaaaagaacauacauaaga

SEQ ID NO: 2495 - RNA, 20 nt, Artificial Sequence
  Synthetic
acaaaagaacauacauaaga

SEQ ID NO: 2496 - RNA, 18 nt, Artificial Sequence
  Synthetic
aaaagaacauacauaaga

SEQ ID NO: 2497 - RNA, 19 nt, Artificial Sequence
  Synthetic
aagaaaaaaaagguaaugc

SEQ ID NO: 2498 - RNA, 18 nt, Artificial Sequence
  Synthetic
agaaaaaaaagguaaugc

SEQ ID NO: 2499 - RNA, 19 nt, Artificial Sequence
  Synthetic
aaacaggaauagaaauuca

SEQ ID NO: 2500 - RNA, 18 nt, Artificial Sequence
  Synthetic
aacaggaauagaaauuca

SEQ ID NO: 2501 - RNA, 24 nt, Artificial Sequence
  Synthetic
aagaucacuccacugcacuccagc

SEQ ID NO: 2502 - RNA, 23 nt, Artificial Sequence
  Synthetic
agaucacuccacugcacuccagc

SEQ ID NO: 2503 - RNA, 21 nt, Artificial Sequence
  Synthetic
aucacuccacugcacuccagc

SEQ ID NO: 2504 - RNA, 18 nt, Artificial Sequence
  Synthetic
acuccacugcacuccagc

SEQ ID NO: 2505 - RNA, 22 nt, Artificial Sequence
  Synthetic
ccccuacuuaccucaugucauc

SEQ ID NO: 2506 - RNA, 21 nt, Artificial Sequence
  Synthetic
cccuacuuaccucaugucauc

SEQ ID NO: 2507 - RNA, 20 nt, Artificial Sequence
  Synthetic
ccuacuuaccucaugucauc

SEQ ID NO: 2508 - RNA, 19 nt, Artificial Sequence
  Synthetic
cuacuuaccucaugucauc

SEQ ID NO: 2509 - RNA, 24 nt, Artificial Sequence
  Synthetic
cugauuuucgugaccucuagucuc

SEQ ID NO: 2510 - RNA, 24 nt, Artificial Sequence
  Synthetic
cacuaaucacucucauguauuagc

SEQ ID NO: 2511 - RNA, 22 nt, Artificial Sequence
  Synthetic
cuaaucacucucauguauuagc

SEQ ID NO: 2512 - RNA, 23 nt, Artificial Sequence
  Synthetic
cucuagaugacaugagguaagua

SEQ ID NO: 2513 - RNA, 21 nt, Artificial Sequence
  Synthetic
cuagaugacaugagguaagua

SEQ ID NO: 2514 - RNA, 23 nt, Artificial Sequence
  Synthetic
ccucaugucaucuagagcaagag

SEQ ID NO: 2515 - RNA, 22 nt, Artificial Sequence
  Synthetic
cucaugucaucuagagcaagag

SEQ ID NO: 2516 - RNA, 20 nt, Artificial Sequence
  Synthetic
caugucaucuagagcaagag

SEQ ID NO: 2517 - RNA, 20 nt, Artificial Sequence
  Synthetic
caugagagugauuaguggug

SEQ ID NO: 2518 - RNA, 20 nt, Artificial Sequence
  Synthetic
cgugcucuuuucuauauaua

SEQ ID NO: 2519 - RNA, 20 nt, Artificial Sequence
  Synthetic
caaaaccuauguauaagaug

SEQ ID NO: 2520 - RNA, 23 nt, Artificial Sequence
  Synthetic
cguacaaaagaacauacauaaga

SEQ ID NO: 2521 - RNA, 19 nt, Artificial Sequence
  Synthetic
caaaagaacauacauaaga

SEQ ID NO: 2522 - RNA, 22 nt, Artificial Sequence
  Synthetic
cuuaagaaaaaaaagguaaugc

SEQ ID NO: 2523 - RNA, 20 nt, Artificial Sequence
  Synthetic
cuuaagcauacuuuuuuuaa

SEQ ID NO: 2524 - RNA, 19 nt, Artificial Sequence
  Synthetic
cacuccacugcacuccagc

SEQ ID NO: 2525 - RNA, 24 nt, Artificial Sequence
  Synthetic
guccccuacuuaccucaugucauc

SEQ ID NO: 2526 - RNA, 22 nt, Artificial Sequence
  Synthetic
gauuuucgugaccucuagucuc

SEQ ID NO: 2527 - RNA, 24 nt, Artificial Sequence
  Synthetic
gcucuagaugacaugagguaagua

SEQ ID NO: 2528 - RNA, 18 nt, Artificial Sequence
  Synthetic
gaugacaugagguaagua

SEQ ID NO: 2529 - RNA, 23 nt, Artificial Sequence
  Synthetic
guacgugcucuuuucuauauaua

SEQ ID NO: 2530 - RNA, 19 nt, Artificial Sequence
  Synthetic
gugcucuuuucuauauaua

SEQ ID NO: 2531 - RNA, 23 nt, Artificial Sequence
  Synthetic
guacaaaaccuauguauaagaug

SEQ ID NO: 2532 - RNA, 23 nt, Artificial Sequence
  Synthetic
gaaaugguucccuauauauagaa

SEQ ID NO: 2533 - RNA, 18 nt, Artificial Sequence
  Synthetic
gguucccuauauauagaa

SEQ ID NO: 2534 - RNA, 22 nt, Artificial Sequence
  Synthetic
ggaauauaagucuuuugauaua

SEQ ID NO: 2535 - RNA, 21 nt, Artificial Sequence
  Synthetic
gaauauaagucuuuugauaua

SEQ ID NO: 2536 - RNA, 22 nt, Artificial Sequence
  Synthetic
guacaaaagaacauacauaaga

SEQ ID NO: 2537 - RNA, 23 nt, Artificial Sequence
  Synthetic
gcuuaagaaaaaaaagguaaugc

SEQ ID NO: 2538 - RNA, 20 nt, Artificial Sequence
  Synthetic
gaaacaggaauagaaauuca

SEQ ID NO: 2539 - RNA, 22 nt, Artificial Sequence
  Synthetic
gaucacuccacugcacuccagc

SEQ ID NO: 2540 - RNA, 23 nt, Artificial Sequence
  Synthetic
uccccuacuuaccucaugucauc

SEQ ID NO: 2541 - RNA, 18 nt, Artificial Sequence
  Synthetic
uacuuaccucaugucauc

SEQ ID NO: 2542 - RNA, 23 nt, Artificial Sequence
  Synthetic
ugauuuucgugaccucuagucuc

SEQ ID NO: 2543 - RNA, 20 nt, Artificial Sequence
  Synthetic
uuuucgugaccucuagucuc

SEQ ID NO: 2544 - RNA, 19 nt, Artificial Sequence
  Synthetic
uuucgugaccucuagucuc

SEQ ID NO: 2545 - RNA, 18 nt, Artificial Sequence
  Synthetic
uucgugaccucuagucuc

SEQ ID NO: 2546 - RNA, 21 nt, Artificial Sequence
  Synthetic
uaaucacucucauguauuagc

SEQ ID NO: 2547 - RNA, 18 nt, Artificial Sequence
  Synthetic
ucacucucauguauuagc

SEQ ID NO: 2548 - RNA, 22 nt, Artificial Sequence
  Synthetic
ucuagaugacaugagguaagua

SEQ ID NO: 2549 - RNA, 20 nt, Artificial Sequence
  Synthetic
uagaugacaugagguaagua

SEQ ID NO: 2550 - RNA, 21 nt, Artificial Sequence
  Synthetic
ucaugucaucuagagcaagag

SEQ ID NO: 2551 - RNA, 18 nt, Artificial Sequence
  Synthetic
ugucaucuagagcaagag

SEQ ID NO: 2552 - RNA, 22 nt, Artificial Sequence
  Synthetic
uacaugagagugauuaguggug

SEQ ID NO: 2553 - RNA, 18 nt, Artificial Sequence
  Synthetic
ugagagugauuaguggug

SEQ ID NO: 2554 - RNA, 24 nt, Artificial Sequence
  Synthetic
uguacgugcucuuuucuauauaua

SEQ ID NO: 2555 - RNA, 22 nt, Artificial Sequence
  Synthetic
uacgugcucuuuucuauauaua

SEQ ID NO: 2556 - RNA, 18 nt, Artificial Sequence
  Synthetic
ugcucuuuucuauauaua

SEQ ID NO: 2557 - RNA, 24 nt, Artificial Sequence
  Synthetic
uguacaaaaccuauguauaagaug

SEQ ID NO: 2558 - RNA, 22 nt, Artificial Sequence
  Synthetic
uacaaaaccuauguauaagaug

SEQ ID NO: 2559 - RNA, 23 nt, Artificial Sequence
  Synthetic
uauauagaaaagagcacguacaa

SEQ ID NO: 2560 - RNA, 21 nt, Artificial Sequence
  Synthetic
uauagaaaagagcacguacaa

SEQ ID NO: 2561 - RNA, 19 nt, Artificial Sequence
  Synthetic
uagaaaagagcacguacaa

SEQ ID NO: 2562 - RNA, 19 nt, Artificial Sequence
  Synthetic
ugguucccuauauauagaa

SEQ ID NO: 2563 - RNA, 23 nt, Artificial Sequence
  Synthetic
uggaauauaagucuuuugauaua

SEQ ID NO: 2564 - RNA, 18 nt, Artificial Sequence
  Synthetic
uauaagucuuuugauaua

SEQ ID NO: 2565 - RNA, 21 nt, Artificial Sequence
  Synthetic
uacaaaagaacauacauaaga

SEQ ID NO: 2566 - RNA, 24 nt, Artificial Sequence
  Synthetic
ugcuuaagaaaaaaaagguaaugc

SEQ ID NO: 2567 - RNA, 21 nt, Artificial Sequence
  Synthetic
uuaagaaaaaaaagguaaugc

SEQ ID NO: 2568 - RNA, 20 nt, Artificial Sequence
  Synthetic
uaagaaaaaaaagguaaugc

SEQ ID NO: 2569 - RNA, 24 nt, Artificial Sequence
  Synthetic
uuuugaaacaggaauagaaauuca

SEQ ID NO: 2570 - RNA, 23 nt, Artificial Sequence
  Synthetic
uuugaaacaggaauagaaauuca

SEQ ID NO: 2571 - RNA, 22 nt, Artificial Sequence
  Synthetic
uugaaacaggaauagaaauuca

SEQ ID NO: 2572 - RNA, 21 nt, Artificial Sequence
  Synthetic
ugaaacaggaauagaaauuca

SEQ ID NO: 2573 - RNA, 24 nt, Artificial Sequence
  Synthetic
uuuucuuaagcauacuuuuuuuaa

SEQ ID NO: 2574 - RNA, 23 nt, Artificial Sequence
  Synthetic
uuucuuaagcauacuuuuuuuaa

SEQ ID NO: 2575 - RNA, 22 nt, Artificial Sequence
  Synthetic
uucuuaagcauacuuuuuuuaa

SEQ ID NO: 2576 - RNA, 21 nt, Artificial Sequence
  Synthetic
ucuuaagcauacuuuuuuuaa

SEQ ID NO: 2577 - RNA, 19 nt, Artificial Sequence
  Synthetic
uuaagcauacuuuuuuuaa

SEQ ID NO: 2578 - RNA, 18 nt, Artificial Sequence
  Synthetic
uaagcauacuuuuuuuaa

SEQ ID NO: 2579 - RNA, 20 nt, Artificial Sequence
  Synthetic
ucacuccacugcacuccagc

SEQ ID NO: 2580 - RNA, 23 nt, Artificial Sequence
  Synthetic
aguuuuuaaggcggggagucaca

SEQ ID NO: 2581 - RNA, 24 nt, Artificial Sequence
  Synthetic
aaacugucaaaagcuaccgguuac

SEQ ID NO: 2582 - RNA, 23 nt, Artificial Sequence
  Synthetic
aacugucaaaagcuaccgguuac

SEQ ID NO: 2583 - RNA, 22 nt, Artificial Sequence
  Synthetic
acugucaaaagcuaccgguuac

SEQ ID NO: 2584 - RNA, 24 nt, Artificial Sequence
  Synthetic
aguucaucucuugcucuagaugac

SEQ ID NO: 2585 - RNA, 19 nt, Artificial Sequence
  Synthetic
aucucuugcucuagaugac

SEQ ID NO: 2586 - RNA, 20 nt, Artificial Sequence
  Synthetic
acgaaaaucagauuucaugu

SEQ ID NO: 2587 - RNA, 21 nt, Artificial Sequence
  Synthetic
aauacaugagagugauuagug

SEQ ID NO: 2588 - RNA, 20 nt, Artificial Sequence
  Synthetic
auacaugagagugauuagug

SEQ ID NO: 2589 - RNA, 18 nt, Artificial Sequence
  Synthetic
acaugagagugauuagug

SEQ ID NO: 2590 - RNA, 23 nt, Artificial Sequence
  Synthetic
auuagcuugaacucugugccaaa

SEQ ID NO: 2591 - RNA, 20 nt, Artificial Sequence
  Synthetic
agcuugaacucugugccaaa

SEQ ID NO: 2592 - RNA, 23 nt, Artificial Sequence
  Synthetic
auguagauugagguagaaucaag

SEQ ID NO: 2593 - RNA, 19 nt, Artificial Sequence
  Synthetic
agauugagguagaaucaag

SEQ ID NO: 2594 - RNA, 23 nt, Artificial Sequence
  Synthetic
auaagaugcagaacuaguguaga

SEQ ID NO: 2595 - RNA, 21 nt, Artificial Sequence
  Synthetic
aagaugcagaacuaguguaga

SEQ ID NO: 2596 - RNA, 20 nt, Artificial Sequence
  Synthetic
agaugcagaacuaguguaga

SEQ ID NO: 2597 - RNA, 18 nt, Artificial Sequence
  Synthetic
augcagaacuaguguaga

SEQ ID NO: 2598 - RNA, 24 nt, Artificial Sequence
  Synthetic
auagauguagauugagguagaauc

SEQ ID NO: 2599 - RNA, 22 nt, Artificial Sequence
  Synthetic
agauguagauugagguagaauc

SEQ ID NO: 2600 - RNA, 20 nt, Artificial Sequence
  Synthetic
auguagauugagguagaauc

SEQ ID NO: 2601 - RNA, 24 nt, Artificial Sequence
  Synthetic
agaaugaucauucuuguggcagua

SEQ ID NO: 2602 - RNA, 22 nt, Artificial Sequence
  Synthetic
aaugaucauucuuguggcagua

SEQ ID NO: 2603 - RNA, 21 nt, Artificial Sequence
  Synthetic
augaucauucuuguggcagua

SEQ ID NO: 2604 - RNA, 18 nt, Artificial Sequence
  Synthetic
aucauucuuguggcagua

SEQ ID NO: 2605 - RNA, 23 nt, Artificial Sequence
  Synthetic
agaaugaucauucuuguggcagu

SEQ ID NO: 2606 - RNA, 21 nt, Artificial Sequence
  Synthetic
aaugaucauucuuguggcagu

SEQ ID NO: 2607 - RNA, 20 nt, Artificial Sequence
  Synthetic
augaucauucuuguggcagu

SEQ ID NO: 2608 - RNA, 21 nt, Artificial Sequence
  Synthetic
agagguaaagguucaugagac

SEQ ID NO: 2609 - RNA, 19 nt, Artificial Sequence
  Synthetic
agguaaagguucaugagac

SEQ ID NO: 2610 - RNA, 20 nt, Artificial Sequence
  Synthetic
agcuuuugacaguuuuuaag

SEQ ID NO: 2611 - RNA, 22 nt, Artificial Sequence
  Synthetic
agcuuuugacaguuuuuaaggc

SEQ ID NO: 2612 - RNA, 23 nt, Artificial Sequence
  Synthetic
agaaauucacugagcaaaacaac

SEQ ID NO: 2613 - RNA, 21 nt, Artificial Sequence
  Synthetic
aaauucacugagcaaaacaac

SEQ ID NO: 2614 - RNA, 20 nt, Artificial Sequence
  Synthetic
aauucacugagcaaaacaac

SEQ ID NO: 2615 - RNA, 19 nt, Artificial Sequence
  Synthetic
auucacugagcaaaacaac

SEQ ID NO: 2616 - RNA, 18 nt, Artificial Sequence
  Synthetic
aguaaggaggauguaaga

SEQ ID NO: 2617 - RNA, 23 nt, Artificial Sequence
  Synthetic
aucaaaagacuuauauuccauua

SEQ ID NO: 2618 - RNA, 20 nt, Artificial Sequence
  Synthetic
aaaagacuuauauuccauua

SEQ ID NO: 2619 - RNA, 19 nt, Artificial Sequence
  Synthetic
aaagacuuauauuccauua

SEQ ID NO: 2620 - RNA, 18 nt, Artificial Sequence
  Synthetic
aagacuuauauuccauua

SEQ ID NO: 2621 - RNA, 21 nt, Artificial Sequence
  Synthetic
aggaaauuauuguugcuuuuu

SEQ ID NO: 2622 - RNA, 18 nt, Artificial Sequence
  Synthetic
aaauuauuguugcuuuuu

SEQ ID NO: 2623 - RNA, 24 nt, Artificial Sequence
  Synthetic
aaagaaaaacuugaaauuugauag

SEQ ID NO: 2624 - RNA, 23 nt, Artificial Sequence
  Synthetic
aagaaaaacuugaaauuugauag

SEQ ID NO: 2625 - RNA, 22 nt, Artificial Sequence
  Synthetic
agaaaaacuugaaauuugauag

SEQ ID NO: 2626 - RNA, 20 nt, Artificial Sequence
  Synthetic
aaaaacuugaaauuugauag

SEQ ID NO: 2627 - RNA, 19 nt, Artificial Sequence
  Synthetic
aaaacuugaaauuugauag

SEQ ID NO: 2628 - RNA, 18 nt, Artificial Sequence
  Synthetic
aaacuugaaauuugauag

SEQ ID NO: 2629 - RNA, 23 nt, Artificial Sequence
  Synthetic
aagaaaaaagaaauagauguaga

SEQ ID NO: 2630 - RNA, 22 nt, Artificial Sequence
  Synthetic
agaaaaaagaaauagauguaga

SEQ ID NO: 2631 - RNA, 20 nt, Artificial Sequence
  Synthetic
aaaaaagaaauagauguaga

SEQ ID NO: 2632 - RNA, 19 nt, Artificial Sequence
  Synthetic
aaaaagaaauagauguaga

SEQ ID NO: 2633 - RNA, 18 nt, Artificial Sequence
  Synthetic
aaaagaaauagauguaga

SEQ ID NO: 2634 - RNA, 23 nt, Artificial Sequence
  Synthetic
agagucucacuguguugcccagg

SEQ ID NO: 2635 - RNA, 21 nt, Artificial Sequence
  Synthetic
agucucacuguguugcccagg

SEQ ID NO: 2636 - RNA, 24 nt, Artificial Sequence
  Synthetic
caguuuuuaaggcggggagucaca

SEQ ID NO: 2637 - RNA, 21 nt, Artificial Sequence
  Synthetic
cugucaaaagcuaccgguuac

SEQ ID NO: 2638 - RNA, 20 nt, Artificial Sequence
  Synthetic
caucucuugcucuagaugac

SEQ ID NO: 2639 - RNA, 21 nt, Artificial Sequence
  Synthetic
cacgaaaaucagauuucaugu

SEQ ID NO: 2640 - RNA, 19 nt, Artificial Sequence
  Synthetic
cgaaaaucagauuucaugu

SEQ ID NO: 2641 - RNA, 23 nt, Artificial Sequence
  Synthetic
cuaauacaugagagugauuagug

SEQ ID NO: 2642 - RNA, 18 nt, Artificial Sequence
  Synthetic
cuugaacucugugccaaa

SEQ ID NO: 2643 - RNA, 21 nt, Artificial Sequence
  Synthetic
cucuagaugacaugagguaag

SEQ ID NO: 2644 - RNA, 19 nt, Artificial Sequence
  Synthetic
cuagaugacaugagguaag

SEQ ID NO: 2645 - RNA, 24 nt, Artificial Sequence
  Synthetic
cgguagcuuuugacaguuuuuaag

SEQ ID NO: 2646 - RNA, 18 nt, Artificial Sequence
  Synthetic
cuuuugacaguuuuuaag

SEQ ID NO: 2647 - RNA, 20 nt, Artificial Sequence
  Synthetic
cuuuugacaguuuuuaaggc

SEQ ID NO: 2648 - RNA, 19 nt, Artificial Sequence
  Synthetic
caguaaggaggauguaaga

SEQ ID NO: 2649 - RNA, 21 nt, Artificial Sequence
  Synthetic
caaaagacuuauauuccauua

SEQ ID NO: 2650 - RNA, 24 nt, Artificial Sequence
  Synthetic
cuuaggaaauuauuguugcuuuuu

SEQ ID NO: 2651 - RNA, 24 nt, Artificial Sequence
  Synthetic
cuguguugcccaggcuggagugca

SEQ ID NO: 2652 - RNA, 24 nt, Artificial Sequence
  Synthetic
cagagucucacuguguugcccagg

SEQ ID NO: 2653 - RNA, 18 nt, Artificial Sequence
  Synthetic
cucacuguguugcccagg

SEQ ID NO: 2654 - RNA, 22 nt, Artificial Sequence
  Synthetic
guuuuuaaggcggggagucaca

SEQ ID NO: 2655 - RNA, 19 nt, Artificial Sequence
  Synthetic
gucaaaagcuaccgguuac

SEQ ID NO: 2656 - RNA, 23 nt, Artificial Sequence
  Synthetic
guucaucucuugcucuagaugac

SEQ ID NO: 2657 - RNA, 24 nt, Artificial Sequence
  Synthetic
ggucacgaaaaucagauuucaugu

SEQ ID NO: 2658 - RNA, 23 nt, Artificial Sequence
  Synthetic
gucacgaaaaucagauuucaugu

SEQ ID NO: 2659 - RNA, 18 nt, Artificial Sequence
  Synthetic
gaaaaucagauuucaugu

SEQ ID NO: 2660 - RNA, 24 nt, Artificial Sequence
  Synthetic
gcuaauacaugagagugauuagug

SEQ ID NO: 2661 - RNA, 19 nt, Artificial Sequence
  Synthetic
gcuugaacucugugccaaa

SEQ ID NO: 2662 - RNA, 22 nt, Artificial Sequence
  Synthetic
gcucuagaugacaugagguaag

SEQ ID NO: 2663 - RNA, 24 nt, Artificial Sequence
  Synthetic
gauguagauugagguagaaucaag

SEQ ID NO: 2664 - RNA, 21 nt, Artificial Sequence
  Synthetic
guagauugagguagaaucaag

SEQ ID NO: 2665 - RNA, 18 nt, Artificial Sequence
  Synthetic
gauugagguagaaucaag

SEQ ID NO: 2666 - RNA, 19 nt, Artificial Sequence
  Synthetic
gaugcagaacuaguguaga

SEQ ID NO: 2667 - RNA, 21 nt, Artificial Sequence
  Synthetic
gauguagauugagguagaauc

SEQ ID NO: 2668 - RNA, 18 nt, Artificial Sequence
  Synthetic
guagauugagguagaauc

SEQ ID NO: 2669 - RNA, 23 nt, Artificial Sequence
  Synthetic
gaaugaucauucuuguggcagua

SEQ ID NO: 2670 - RNA, 19 nt, Artificial Sequence
  Synthetic
gaucauucuuguggcagua

SEQ ID NO: 2671 - RNA, 22 nt, Artificial Sequence
  Synthetic
gaaugaucauucuuguggcagu

SEQ ID NO: 2672 - RNA, 18 nt, Artificial Sequence
  Synthetic
gaucauucuuguggcagu

SEQ ID NO: 2673 - RNA, 22 nt, Artificial Sequence
  Synthetic
gagagguaaagguucaugagac

SEQ ID NO: 2674 - RNA, 20 nt, Artificial Sequence
  Synthetic
gagguaaagguucaugagac

SEQ ID NO: 2675 - RNA, 18 nt, Artificial Sequence
  Synthetic
gguaaagguucaugagac

SEQ ID NO: 2676 - RNA, 23 nt, Artificial Sequence
  Synthetic
gguagcuuuugacaguuuuuaag

SEQ ID NO: 2677 - RNA, 22 nt, Artificial Sequence
  Synthetic
guagcuuuugacaguuuuuaag

SEQ ID NO: 2678 - RNA, 19 nt, Artificial Sequence
  Synthetic
gcuuuugacaguuuuuaag

SEQ ID NO: 2679 - RNA, 24 nt, Artificial Sequence
  Synthetic
guagcuuuugacaguuuuuaaggc

SEQ ID NO: 2680 - RNA, 21 nt, Artificial Sequence
  Synthetic
gcuuuugacaguuuuuaaggc

SEQ ID NO: 2681 - RNA, 22 nt, Artificial Sequence
  Synthetic
gaaauucacugagcaaaacaac

SEQ ID NO: 2682 - RNA, 23 nt, Artificial Sequence
  Synthetic
guggcaguaaggaggauguaaga

SEQ ID NO: 2683 - RNA, 21 nt, Artificial Sequence
  Synthetic
ggcaguaaggaggauguaaga

SEQ ID NO: 2684 - RNA, 20 nt, Artificial Sequence
  Synthetic
gcaguaaggaggauguaaga

SEQ ID NO: 2685 - RNA, 20 nt, Artificial Sequence
  Synthetic
ggaaauuauuguugcuuuuu

SEQ ID NO: 2686 - RNA, 19 nt, Artificial Sequence
  Synthetic
gaaauuauuguugcuuuuu

SEQ ID NO: 2687 - RNA, 21 nt, Artificial Sequence
  Synthetic
gaaaaacuugaaauuugauag

SEQ ID NO: 2688 - RNA, 24 nt, Artificial Sequence
  Synthetic
gaagaaaaaagaaauagauguaga

SEQ ID NO: 2689 - RNA, 21 nt, Artificial Sequence
  Synthetic
gaaaaaagaaauagauguaga

SEQ ID NO: 2690 - RNA, 22 nt, Artificial Sequence
  Synthetic
guguugcccaggcuggagugca

SEQ ID NO: 2691 - RNA, 20 nt, Artificial Sequence
  Synthetic
guugcccaggcuggagugca

SEQ ID NO: 2692 - RNA, 22 nt, Artificial Sequence
  Synthetic
gagucucacuguguugcccagg

SEQ ID NO: 2693 - RNA, 20 nt, Artificial Sequence
  Synthetic
gucucacuguguugcccagg

SEQ ID NO: 2694 - RNA, 21 nt, Artificial Sequence
  Synthetic
uuuuuaaggcggggagucaca

SEQ ID NO: 2695 - RNA, 20 nt, Artificial Sequence
  Synthetic
uuuuaaggcggggagucaca

SEQ ID NO: 2696 - RNA, 19 nt, Artificial Sequence
  Synthetic
uuuaaggcggggagucaca

SEQ ID NO: 2697 - RNA, 18 nt, Artificial Sequence
  Synthetic
uuaaggcggggagucaca

SEQ ID NO: 2698 - RNA, 20 nt, Artificial Sequence
  Synthetic
ugucaaaagcuaccgguuac

SEQ ID NO: 2699 - RNA, 18 nt, Artificial Sequence
  Synthetic
ucaaaagcuaccgguuac

SEQ ID NO: 2700 - RNA, 22 nt, Artificial Sequence
  Synthetic
uucaucucuugcucuagaugac

SEQ ID NO: 2701 - RNA, 21 nt, Artificial Sequence
  Synthetic
ucaucucuugcucuagaugac

SEQ ID NO: 2702 - RNA, 18 nt, Artificial Sequence
  Synthetic
ucucuugcucuagaugac

SEQ ID NO: 2703 - RNA, 22 nt, Artificial Sequence
  Synthetic
ucacgaaaaucagauuucaugu

SEQ ID NO: 2704 - RNA, 22 nt, Artificial Sequence
  Synthetic
uaauacaugagagugauuagug

SEQ ID NO: 2705 - RNA, 19 nt, Artificial Sequence
  Synthetic
uacaugagagugauuagug

SEQ ID NO: 2706 - RNA, 24 nt, Artificial Sequence
  Synthetic
uauuagcuugaacucugugccaaa

SEQ ID NO: 2707 - RNA, 22 nt, Artificial Sequence
  Synthetic
uuagcuugaacucugugccaaa

SEQ ID NO: 2708 - RNA, 21 nt, Artificial Sequence
  Synthetic
uagcuugaacucugugccaaa

SEQ ID NO: 2709 - RNA, 24 nt, Artificial Sequence
  Synthetic
uugcucuagaugacaugagguaag

SEQ ID NO: 2710 - RNA, 23 nt, Artificial Sequence
  Synthetic
ugcucuagaugacaugagguaag

SEQ ID NO: 2711 - RNA, 20 nt, Artificial Sequence
  Synthetic
ucuagaugacaugagguaag

SEQ ID NO: 2712 - RNA, 18 nt, Artificial Sequence
  Synthetic
uagaugacaugagguaag

SEQ ID NO: 2713 - RNA, 22 nt, Artificial Sequence
  Synthetic
uguagauugagguagaaucaag

SEQ ID NO: 2714 - RNA, 20 nt, Artificial Sequence
  Synthetic
uagauugagguagaaucaag

SEQ ID NO: 2715 - RNA, 24 nt, Artificial Sequence
  Synthetic
uauaagaugcagaacuaguguaga

SEQ ID NO: 2716 - RNA, 22 nt, Artificial Sequence
  Synthetic
uaagaugcagaacuaguguaga

SEQ ID NO: 2717 - RNA, 23 nt, Artificial Sequence
  Synthetic
uagauguagauugagguagaauc

SEQ ID NO: 2718 - RNA, 19 nt, Artificial Sequence
  Synthetic
uguagauugagguagaauc

SEQ ID NO: 2719 - RNA, 20 nt, Artificial Sequence
  Synthetic
ugaucauucuuguggcagua

SEQ ID NO: 2720 - RNA, 24 nt, Artificial Sequence
  Synthetic
uagaaugaucauucuuguggcagu

SEQ ID NO: 2721 - RNA, 19 nt, Artificial Sequence
  Synthetic
ugaucauucuuguggcagu

SEQ ID NO: 2722 - RNA, 24 nt, Artificial Sequence
  Synthetic
uugagagguaaagguucaugagac

SEQ ID NO: 2723 - RNA, 23 nt, Artificial Sequence
  Synthetic
ugagagguaaagguucaugagac

SEQ ID NO: 2724 - RNA, 21 nt, Artificial Sequence
  Synthetic
uagcuuuugacaguuuuuaag

SEQ ID NO: 2725 - RNA, 23 nt, Artificial Sequence
  Synthetic
uagcuuuugacaguuuuuaaggc

SEQ ID NO: 2726 - RNA, 19 nt, Artificial Sequence
  Synthetic
uuuugacaguuuuuaaggc

SEQ ID NO: 2727 - RNA, 18 nt, Artificial Sequence
  Synthetic
uuugacaguuuuuaaggc

SEQ ID NO: 2728 - RNA, 24 nt, Artificial Sequence
  Synthetic
uagaaauucacugagcaaaacaac

SEQ ID NO: 2729 - RNA, 18 nt, Artificial Sequence
  Synthetic
uucacugagcaaaacaac

SEQ ID NO: 2730 - RNA, 24 nt, Artificial Sequence
  Synthetic
uguggcaguaaggaggauguaaga

SEQ ID NO: 2731 - RNA, 22 nt, Artificial Sequence
  Synthetic
uggcaguaaggaggauguaaga

SEQ ID NO: 2732 - RNA, 24 nt, Artificial Sequence
  Synthetic
uaucaaaagacuuauauuccauua

SEQ ID NO: 2733 - RNA, 22 nt, Artificial Sequence
  Synthetic
ucaaaagacuuauauuccauua

SEQ ID NO: 2734 - RNA, 23 nt, Artificial Sequence
  Synthetic
uuaggaaauuauuguugcuuuuu

SEQ ID NO: 2735 - RNA, 22 nt, Artificial Sequence
  Synthetic
uaggaaauuauuguugcuuuuu

SEQ ID NO: 2736 - RNA, 23 nt, Artificial Sequence
  Synthetic
uguguugcccaggcuggagugca

SEQ ID NO: 2737 - RNA, 21 nt, Artificial Sequence
  Synthetic
uguugcccaggcuggagugca

SEQ ID NO: 2738 - RNA, 19 nt, Artificial Sequence
  Synthetic
uugcccaggcuggagugca

SEQ ID NO: 2739 - RNA, 18 nt, Artificial Sequence
  Synthetic
ugcccaggcuggagugca

SEQ ID NO: 2740 - RNA, 19 nt, Artificial Sequence
  Synthetic
ucucacuguguugcccagg

SEQ ID NO: 2741 - RNA, 22 nt, Artificial Sequence
  Synthetic
augagauacucacaauuacaac

SEQ ID NO: 2742 - RNA, 24 nt, Artificial Sequence
  Synthetic
guaugagauacucacaauuacaac

SEQ ID NO: 2743 - RNA, 23 nt, Artificial Sequence
  Synthetic
uaugagauacucacaauuacaac

SEQ ID NO: 2744 - RNA, 24 nt, Artificial Sequence
  Synthetic
gguaugagauauucacaauuacaa

SEQ ID NO: 2745 - RNA, 17 nt, Artificial Sequence
  Synthetic
aaaagcagcagaaagca

SEQ ID NO: 2746 - RNA, 20 nt, Artificial Sequence
  Synthetic
aacguuguucugaguagcuu

SEQ ID NO: 2747 - RNA, 17 nt, Artificial Sequence
  Synthetic
aauagaggcuuauggau

SEQ ID NO: 2748 - RNA, 20 nt, Artificial Sequence
  Synthetic
acuuaaugagugcuucccuc

SEQ ID NO: 2749 - RNA, 20 nt, Artificial Sequence
  Synthetic
agaaauagaggcuuauggau

SEQ ID NO: 2750 - RNA, 17 nt, Artificial Sequence
  Synthetic
agcagaaagcaaacuga

SEQ ID NO: 2751 - RNA, 20 nt, Artificial Sequence
  Synthetic
agcagcagaaagcaaacuga

SEQ ID NO: 2752 - RNA, 17 nt, Artificial Sequence
  Synthetic
agggucugguccauauu

SEQ ID NO: 2753 - RNA, 20 nt, Artificial Sequence
  Synthetic
auaguggcugaaugacuucu

SEQ ID NO: 2754 - RNA, 17 nt, Artificial Sequence
  Synthetic
augucugguuaaaagag

SEQ ID NO: 2755 - RNA, 20 nt, Artificial Sequence
  Synthetic
caaagggucugguccauauu

SEQ ID NO: 2756 - RNA, 17 nt, Artificial Sequence
  Synthetic
caucagaaauagaggcu

SEQ ID NO: 2757 - RNA, 20 nt, Artificial Sequence
  Synthetic
ccucaucagaaauagaggcu

SEQ ID NO: 2758 - RNA, 17 nt, Artificial Sequence
  Synthetic
cugaggacagaacaagc

SEQ ID NO: 2759 - RNA, 20 nt, Artificial Sequence
  Synthetic
cugcugcuuuugccaaagag

SEQ ID NO: 2760 - RNA, 17 nt, Artificial Sequence
  Synthetic
cugcuuuugccaaagag

SEQ ID NO: 2761 - RNA, 17 nt, Artificial Sequence
  Synthetic
uaaugagugcuucccuc

SEQ ID NO: 2762 - RNA, 20 nt, Artificial Sequence
  Synthetic
uagaugucugguuaaaagag

SEQ ID NO: 2763 - RNA, 20 nt, Artificial Sequence
  Synthetic
ucauucuccuuaggucacuu

SEQ ID NO: 2764 - RNA, 20 nt, Artificial Sequence
  Synthetic
uuacugaggacagaacaagc

SEQ ID NO: 2765 - RNA, 17 nt, Artificial Sequence
  Synthetic
uucuccuuaggucacuu

SEQ ID NO: 2766 - RNA, 17 nt, Artificial Sequence
  Synthetic
aagaaaaaagaaauaga

SEQ ID NO: 2767 - RNA, 20 nt, Artificial Sequence
  Synthetic
agauugagguagaaucaaga

SEQ ID NO: 2768 - RNA, 20 nt, Artificial Sequence
  Synthetic
agucacaugggagucacagg

SEQ ID NO: 2769 - RNA, 17 nt, Artificial Sequence
  Synthetic
caaaaaaagaauccucu

SEQ ID NO: 2770 - RNA, 20 nt, Artificial Sequence
  Synthetic
caacaaaaaaagaauccucu

SEQ ID NO: 2771 - RNA, 17 nt, Artificial Sequence
  Synthetic
cacaugggagucacagg

SEQ ID NO: 2772 - RNA, 17 nt, Artificial Sequence
  Synthetic
cauucuucacacaugaa

SEQ ID NO: 2773 - RNA, 20 nt, Artificial Sequence
  Synthetic
uagaagaaaaaagaaauaga

SEQ ID NO: 2774 - RNA, 20 nt, Artificial Sequence
  Synthetic
ugagacuagaggucacgaaa

SEQ ID NO: 2775 - RNA, 17 nt, Artificial Sequence
  Synthetic
uucaagcuaauacauga

SEQ ID NO: 2776 - RNA, 20 nt, Artificial Sequence
  Synthetic
uuccauucuucacacaugaa

SEQ ID NO: 2777 - RNA, 17 nt, Artificial Sequence
  Synthetic
uugagguagaaucaaga

SEQ ID NO: 2778 - RNA, 102 nt, Artificial Sequence; identical to SEQ ID NO: 45
  Synthetic
  misc_feature (1)..(20): n is a, c, g, or u

SEQ ID NO: 2779 - RNA, 102 nt, Artificial Sequence
  Synthetic
  misc_feature (1)..(20): n is a, c, g, or u
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 2780 - RNA, 17 nt, Artificial Sequence
  Synthetic
ucauucuuguggcagua

What is claimed is:

1. A method of altering a cell comprising contacting said cell with:
   (a) a viral vector comprising a nucleotide sequence encoding a first gRNA molecule, wherein the first gRNA molecule comprises a targeting domain which is complementary with a first target domain from the CEP290 gene, and wherein said targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492); and
   (b) a viral vector comprising a nucleotide sequence encoding a Cas9 molecule;
   wherein said viral vector comprising a nucleotide sequence encoding a first gRNA molecule and said viral vector comprising a nucleotide sequence encoding a Cas9 molecule are capable of delivery to a non-dividing cell, and wherein said contacting results in NHEJ-mediated alteration of the LCA10 target position.

2. The method of claim 1, further comprising contacting said cell with (c) a viral vector comprising a nucleotide sequence encoding a second gRNA molecule, wherein the second gRNA molecule comprises a targeting domain which is complementary with a second target domain from the CEP290 gene, wherein said targeting domain comprises a nucleotide sequence selected from the group consisting of SEQ ID NO:558 (CEP290-64), SEQ ID NO:2321 (CEP290-11), SEQ ID NO:2312 (CEP290-230), SEQ ID NO:460 (CEP290-496), SEQ ID NO:586 (CEP290-502), and SEQ ID NO:568 (CEP290-504), and wherein said viral vector comprising a nucleotide sequence encoding a second gRNA molecule is capable of delivery to a non-dividing cell.

3. The method of claim 2, wherein the viral vector comprising a nucleotide sequence encoding a first gRNA molecule, the viral vector comprising a nucleotide sequence encoding a second gRNA molecule, and the viral vector comprising a nucleotide sequence encoding a Cas9 molecule are all the same viral vector.

4. The method of claim 2, wherein said targeting domain of said first gRNA molecule comprises the nucleotide sequence of SEQ ID NO:530 (CEP290-323) and said targeting domain of said second gRNA molecule comprises a nucleotide sequence selected from the group consisting of SEQ ID NO:558 (CEP290-64) and SEQ ID NO:2321 (CEP290-11).

5. The method of claim 2, wherein said targeting domain of said first gRNA molecule comprises the nucleotide sequence of SEQ ID NO:468 (CEP290-490) and said targeting domain of said second gRNA molecule comprises a nucleotide sequence selected from the group consisting of SEQ ID NO:460 (CEP290-496), SEQ ID NO:586 (CEP290-502), and SEQ ID NO:568 (CEP290-504).

6. The method of claim 2, wherein said targeting domain of said first gRNA molecule comprises the nucleotide sequence of SEQ ID NO:538 (CEP290-492) and said targeting domain of said second gRNA molecule comprises a nucleotide sequence selected from the group consisting of SEQ ID NO:586 (CEP290-502) and SEQ ID NO:568 (CEP290-504).

7. The method of claim 1, wherein said cell is from a subject suffering from LCA10, or from a subject having a mutation at the LCA10 target position of the CEP290 gene.

8. The method of claim 1, wherein the contacting is performed in vivo.

9. The method of claim 1, wherein said viral vector comprising a nucleotide sequence encoding a first gRNA molecule and said viral vector comprising a nucleotide sequence encoding a Cas9 molecule are selected from the group consisting of an AAV vector, an adenovirus vector, a vaccinia virus vector, and a herpes simplex virus vector.

10. The method of claim 9, wherein said viral vector comprising a nucleotide sequence encoding a first gRNA molecule and said viral vector comprising a nucleotide sequence encoding a Cas9 molecule are AAV vectors.

11. The method of claim 1, wherein said NHEJ-mediated alteration is introduction of an indel or deletion of a genomic sequence.

12. The method of claim 1, wherein the contacting is performed ex vivo.

13. The method of claim 1, wherein the viral vector comprising a nucleotide sequence encoding a first gRNA molecule and the viral vector comprising a nucleotide sequence encoding a Cas9 molecule are the same viral vector.

14. The method of claim 1, wherein the viral vector comprising a nucleotide sequence encoding a first gRNA molecule and the viral vector comprising a nucleotide sequence encoding a Cas9 molecule are separate viral vectors.

15. A method of altering a cell comprising contacting the cell with a recombinant viral particle comprising:
   (a) a nucleotide sequence encoding a first gRNA molecule comprising a targeting domain which is complementary with a first target domain from the CEP290 gene, wherein said targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492); and
   (b) a nucleotide sequence encoding a Cas9 molecule;
   wherein said viral particle is capable of delivery to a non-dividing cell, and wherein said contacting results in NHEJ-mediated alteration of the LCA10 target position.

16. The method of claim 15, wherein said recombinant viral particle is selected from the group consisting of an AAV viral particle, an adenovirus viral particle, a vaccinia virus viral particle, and a herpes simplex virus viral particle.

17. The method of claim 16, wherein said recombinant viral particle is an AAV viral particle.

18. The method of claim 15, wherein said viral particle further comprises a nucleotide sequence encoding a second gRNA molecule comprising a targeting domain which is complementary with a second target domain from the CEP290 gene, wherein said targeting domain comprises a nucleotide sequence selected from the group consisting of SEQ ID NO:558 (CEP290-64), SEQ ID NO:2321 (CEP290-11), SEQ ID NO:2312 (CEP290-230), SEQ ID NO:460 (CEP290-496), SEQ ID NO:586 (CEP290-502), and SEQ ID NO:568 (CEP290-504).

19. The method of claim 18, wherein said targeting domain of said first gRNA molecule comprises the nucleotide sequence of SEQ ID NO:530 (CEP290-323) and said targeting domain of said second gRNA molecule comprises a nucleotide sequence selected from the group consisting of SEQ ID NO:558 (CEP290-64) and SEQ ID NO:2321 (CEP290-11).

20. The method of claim 18, wherein said targeting domain of said first gRNA molecule comprises the nucleotide sequence of SEQ ID NO:468 (CEP290-490) and said targeting domain of said second gRNA molecule comprises a nucleotide sequence selected from the group consisting of SEQ ID NO:460 (CEP290-496), SEQ ID NO:586 (CEP290-502), and SEQ ID NO:568 (CEP290-504).

21. The method of claim 18, wherein said targeting domain of said first gRNA molecule comprises the nucleotide sequence of SEQ ID NO:538 (CEP290-492) and said targeting domain of said second gRNA molecule comprises a nucleotide sequence selected from the group consisting of SEQ ID NO:586 (CEP290-502) and SEQ ID NO:568 (CEP290-504).

22. The method of claim 15, wherein said NHEJ-mediated alteration is introduction of an indel or deletion of a genomic sequence.

23. A CRISPR-Cas9 mediated method of altering a cell, comprising forming a first DNA double strand break between the 5' end of the Alu repeat at c.2991+1162 to c.2991.1638 of intron 26 of the CEP290 gene and 500 nucleotides upstream of said 5' end of the Alu repeat, and forming a second DNA double strand break between the LCA10 target position and 500 nucleotides downstream of the LCA10 target position, wherein the first and second DNA double strand breaks are repaired by NHEJ in a manner that results in alteration of the LCA10 target position.

24. The method of claim 23, wherein the step of forming the first and second DNA double strand breaks comprises contacting the cell with a first and a second gRNA molecule configured to form a first and a second complex with a Cas9 molecule, respectively, said first complex configured to form the first DNA double strand break and said second complex configured to form the second DNA double strand break.

25. The method of claim 24, wherein the step of contacting the cell with the first and second gRNA molecules comprises contacting the cell with a first recombinant viral vector comprising a nucleotide sequence encoding the first gRNA molecule and a second recombinant viral vector comprising a nucleotide sequence encoding the second gRNA molecule, wherein said first and second recombinant viral vectors are capable of delivery to a non-dividing cell.

26. The method of claim 24, wherein said first gRNA molecule comprises a targeting domain comprising a nucleotide sequence selected from the group consisting of SEQ ID NO:530 (CEP290-323) and SEQ ID NO:555 (CEP290-485).

27. The method of claim 24, wherein said second gRNA molecule comprises a targeting domain comprising a nucleotide sequence selected from the group consisting of SEQ ID NO:558 (CEP290-64), SEQ ID NO:2321 (CEP290-11), SEQ ID NO:460 (CEP290-496), and SEQ ID NO:586 (CEP290-502).

28. The method of claim 24, wherein said first gRNA molecule comprises a targeting domain comprising the nucleotide sequence of SEQ ID NO:530 (CEP290-323) and said second gRNA molecule comprises a targeting domain comprising a nucleotide sequence selected from the group consisting of SEQ ID NO:558 (CEP290-64) and SEQ ID NO:2321 (CEP290-11).

29. The method of claim 24, wherein the Cas9 molecule is an *S. aureus* Cas9 molecule.

30. The method of claim 24, wherein the step of contacting the cell with the first and second gRNA molecules comprises contacting the cell with a recombinant viral vector comprising a nucleotide sequence encoding the first gRNA molecule and a nucleotide sequence encoding the second gRNA molecule, wherein said recombinant viral vector is capable of delivery to a non-dividing cell.

31. The method of claim 30, wherein the recombinant viral vector further comprises a nucleotide sequence encoding the Cas9 molecule.

32. The method of claim 23, wherein said alteration results in loss or destruction of a cryptic splice site resulting from a mutation at the LCA10 position.

33. A method of altering a cell comprising contacting said cell with:
  (a) a viral vector encoding a first gRNA molecule comprising a targeting domain which is complementary with a first target domain from the CEP290 gene, wherein said targeting domain comprises a nucleotide sequence selected from the group consisting of SEQ ID NO:530 (CEP290-323), SEQ ID NO:555 (CEP290-485), SEQ ID NO:468 (CEP290-490), and SEQ ID NO:538 (CEP290-492), and wherein said viral vector is capable of delivery to a non-dividing cell; and
  (b) a Cas9 molecule;
  wherein said contacting results in NHEJ-mediated introduction of an indel or deletion comprising the LCA10 target position.

34. The method of claim 33, further comprising contacting said cell with (c) a viral vector encoding a second gRNA molecule comprising a targeting domain complementary with a second target domain from the CEP290 gene, wherein said targeting domain comprises a nucleotide sequence selected from the group consisting of SEQ ID NO:558 (CEP290-64), SEQ ID NO:2321 (CEP290-11), SEQ ID NO:2312 (CEP290-230), SEQ ID NO:460 (CEP290-496), SEQ ID NO:586 (CEP290-502), and SEQ ID NO:568 (CEP290-504).

35. The method of claim 34, wherein said targeting domain of said first gRNA molecule comprises the nucleotide sequence of SEQ ID NO:530 (CEP290-323) and said targeting domain of said second gRNA molecule comprises a nucleotide sequence selected from the group consisting of SEQ ID NO:558 (CEP290-64) and SEQ ID NO:2321 (CEP290-11).

36. The method of claim 34, wherein said targeting domain of said first gRNA molecule comprises the nucleotide sequence of SEQ ID NO:468 (CEP290-490) and said targeting domain of said second gRNA molecule comprises a nucleotide sequence selected from the group consisting of SEQ ID NO:460 (CEP290-496), SEQ ID NO:586 (CEP290-502), and SEQ ID NO:568 (CEP290-504).

37. The method of claim 34, wherein said targeting domain of said first gRNA molecule comprises the nucleotide sequence of SEQ ID NO:538 (CEP290-492) and said targeting domain of said second gRNA molecule comprises a nucleotide sequence selected from the group consisting of SEQ ID NO:586 (CEP290-502) and SEQ ID NO:568 (CEP290-504).

38. The method of claim 30 or claim 25, wherein said recombinant viral vector(s) are selected from the group consisting of an AAV vector, an adenovirus vector, a vaccinia virus vector, and a herpes simplex virus vector.

39. The method of claim 38, wherein said recombinant viral vector(s) are AAV vectors.

\* \* \* \* \*